United States Patent 7,411,051 (ANTIBODIES TO HDPPA04 POLYPEPTIDE) - sequence listing, part 6

SEQ ID NO: 12714 - DNA, 212 bp, Homo sapiens
ttttttttttttcattcataaaacttttattccacttacatgaatttaatacacgtgttcttaacaattatgcttggattattaatgaaaatttcataagatattaaacaaagctagccatcatctcaagttatttccttgttaactatttttacagcacatgcatgttaggcaagtatcaaaaaaaatcacaacagcaaaaaaactaaaaa

SEQ ID NO: 12715 - DNA, 296 bp, Homo sapiens
ttaagtgccatctttgcttgcttctcttctggatagcagaggctatgtattgtgggcccttcagatgtgcaagatggctctattggtgatggtgcccttcttgcagagctggcagggagttctaccaggctggcagtatgagaattcatgacctgtgttctgttcaaacttctggtggggtttgctccatgggcaaaagatttgttgcagtgggatggtactgttaggttgtccttaacagtatgagttgggcagacaagggcctacctaagaccattgtccccttgactggacca

SEQ ID NO: 12716 - DNA, 1379 bp, Homo sapiens
tcccaataaaatactcatgcaattttatttctagttgatacaattttaaaggccatgtacaaatgttatacatttttatttttgttctttttttaggaaaaaatacacaaaaggcaaaacatcctcaaatggtccttttatacagtgcagaaggaaatttcaaatttcaaatacgtgtcacaaatgctgcactctagcagccaaaatacaaaaaaaaaaaaggagggtagtccttcatattatatatatatttatataaaacatatggaaatttgtttttacacagatcggtctttgtttcaaatttacaatggatatctaaaaaaaattctacacggcaaatattgccaacaaagttacaccattaatactgataaacggaggagcctacgcggtgttttgattattagggaaagaaagtagaataaataaacaggagccttgctatagttctttaaaaagtgccttaacctttctgcgtccccgcaatcctgaatccgcgcggtcaccgggccgtcctagtccctgcgtcgcgctgtgttcggctcgttctcggaccagaaagtttacagtagaggttgggagacagaaaaatacccactgaaaaagtctaaataaaattcaagacaaaacataacagaagaggctgaagcgaaggaagaggaggaacatggaaggggacggaggcggacgcccggacggccgcttgcttcgtggctcctttgactttctgtttaaagacggacagtggcttccgaaatgcaagttgttcgcacaaagatccacctgtggtccacggaggagacttcggaggtggggagggagatcgggagggagatctgagctcttgtcacttcccgctccctgcaaaagacggctctaaagggagacttgcgcattccaagacattctttcaaaaaaaaaataaaaaataaaaagataaatactcaaccaaaaaataaaagtatttgataatgattggtctcacatgtttgcttttcttctaaaaattttcccccacttctgccattggccggaaggaggggggacctcagcagaattcctgtgtgggtgcgggggctttcccctgcacagcaccgtctcaggcgggttcaacaggatcaaaaacttttatttaccgatggctgcagtcagatcagacccaccactaacattgcttaacaattttgaaggagtgaggaaggaggtgccaaccgcagcgctgtgtctttgcattggggactccttgccaaaaactccggttggggagaggtggaacccttttcttctgccgacggttatacctcgagaagaaagcagtttcttgtgccggtccagggtccctgtgacccgcctgcctgcaccaggagggcctgcgg

SEQ ID NO: 12717 - DNA, 411 bp, Homo sapiens
ttggggacactaattgcccaggcgagtttattgataattttgatgtaacagagcaccggagaaattacccccacgtccaaaatgtcaactctgacgaagaaccaggttcagagactcacgaccccacgacgcaagacactgcggtgggtctggaaggaccgcaccaacaatgtgacttactgtgtttgtttttctcggtagccgggaactggaatagaaagagggtggtcagtggaaggtacaagtgttaaaaaatatttttcccccagagaggacgaactgtgacttaggagataaatgttacaggattggaaaggtgcctgtcacctggcccaccaagcgcccttttgcctcatttagattttgcttgattttctatcggggaaaaccaagaacaaggcaccaaaaagc

SEQ ID NO: 12718 - DNA, 11470 bp, Homo sapiens
acaggatctaccccctctgcagcccttcaagaagaggtatgattgctaccacttttccccacaaagtgacgaaaggaaacagcgacggaagcgcaaccgaaccctggaattggtgtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggctgcggccgggatttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcagggtgagtagagggcccgggagacgcgggagagcgtcgaagagagaggtgcggaaggggctggaggaactggggcaagcctgggagcctgaattggggacgataagtcggaggtgaagtttgggcggaggtgaggggttgggtctgggagatttgtcctttcccgcagttggtttccaccttccaaggatctcacagattcctcctatattcctcccagcgacgtcagagaaggcccaaggccgagactcgtgagggggctgtgctgacctaggcaggccgagtcaggtgccttaggggaggatccaggaacggatacctcgcccttccgtgctcgcacactctggctgtcatcgctctgaagactctttaattagatttctcccctttccagtgcgttcacttttctacagatgagtctcttggtggagacagttaccctacctggtccatgtctccctaaccatccggaaggctaacttccacttttcaagcagctttggctggtttccctccttgatttctctggctcccactactattgcttgtctcactgcccctgtcttttctcagggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagtaagaagatggagtggtctggaggggagaggggcaaaggactgcactatgggaagtggggcagcccctgggtgctggtttggaagaggaggcactaagggaggacattagagggaaaggagcatccctgccctccctcatgtttcccctaccccaccccaccccaggaaggcagatgaggggttagcatcgctgagtgaggacggaagatcacccatctccatccgccagatggcctatggtgagccaagggagagggactggaggagggagttggacagccccctcctctagggaagtctctaaatatccacatgttctaagtggcttcttactttccttcatccgtcacttccaaagaaagttggtctggagggagagtagatgtgaaagaattgtaaccgggaatggggaggggtcagtggtgaacaggcaatagtgtgatctctgacattgatgagatcctcccttcccccagtttctggtctctccttcggtatcatcagtggtgtcttctctgttatcaatattttggctgatgcacttgggccaggtgtggttgggatccatggagactcaccctattacttcctgacttcaggtaagatccaccttctatctagcctttaccccccatccatccttgtccctgatctgatttattggccttccctgagagacttctttggctcaacatctcaggagcctgggagaagatcagggatgtatctcctccccatctccctccctgcagcctttctgacagcagccattatcctgctccataccttttggggagttgtgttctttgatgcctgtgagaggagacggtactgggctttgggcctggtggttgggagtcacctactgacatcgggactggtgagttggagacaggggcctgagttagggagaaaagcatttaatggtgagtgggatgtgggggaaagggtatcctcacttcttaacatttttaacttacctgggaggaggaggaaaggtgagtctttcaaggtctctcacctcagcatcatttctatcacctgctctggggaggaggttgaaaggattagtcaaactgtaatgcagagggcctgaggtgagcaggagcggcagaaacctttgagtttctgaggagctgaaaatcaaaagtccccttaaccacaagatgttggtgctctgaagggaaagactggagaatttgagagagatatctgggagtcagaaaggtacagagagaatatggggattaggtcgagggagaatctaatctctttcctactcttaccctccttcctagacattcctgaacccctggtatgaggccagcctgctgcccatctatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaattgtgggggaacttggcttttaagggaggggatagcatgttaattgagatttctgtcctcagatctctcatccagccactttcctaacctggcaaccactgatttccaagcatagccttggtgcaagggcagaaatctgggctagtggtttaacatgtctgaaactttgggttaagtgtcttcccagaagcttatctttccttccaggggtgggataaaaggagttaatcacccatgcttcttttccccatcctttgcccatctttaccacctgagggattcaggaacttgcccaccctcaagagcctcaaaggataggccagaattaaagtcagaaactttaatttccaaatatattgatcaaaaatatacaacttcaacagcaactctttatcctaaggagagatcccgcagtatatctagggaaagggccataaaagtgagggggtagaggactttggggtatatcccaaacttcccctgcaactaaacagagtttgttctctgcattaacaacacagcgatttcctcatttcctcctacatgtttggagaggctgaaggctctgcagttcttcctggaatgacagcctgggtccattcctctctaggagatgtccaggggaaggaggacatctgcttactactcctacagtgtttctggccagatcctacaccccattttagaggcttcctgataggcatgaagggaagtcatccacatccatggtatctgagaaggaatttatgcctcagtcgtggcttgtgctgaggtgaagaccacactctttcggttttccagcctcttcttcctggaaaggggaatggctcatgagaatgactgctatctaagtgaagcagattagaggtgaaataggagaatgctttttaacagaaaagagggctgggcaaggtgtttcacacctataatcccagcactttgggaggctgaggcgggcggatcacttgaggtcaggagttggagaccagcctgggcaatgtagtgaaaacccgtctctgctaaaaatacaaaaattatctgggcatggtggcacatgcctgtagtcccacctactcaggaggctgaggtgggaggaccacttgagcccgggaggtggaggttgcagtgagctgtgataaagccatgcactccagcctcgacaacagtgagaacctgtctcaaaaagcgggtggctcatgcctataatcccagtactttgggaggctgaggcaggcgaattgcctgaggtcaggagtttgagaccagcctggccaatatggtgaaaccttgtctctactaaaagtacaaaaattagctgggtgtgatggtgcgtgcctgtagtcccagctactcgggaggctgaggcaggagaattgcttgaacccagaaggcagaggttgcagtgagctgagattgcacaccactgcactccagactgagtaacagagcaagactccgtctcccacctaccaaaaaaaaaaaaaaaaaagaagaagggactggaggaatggaaagtagggcctcaccgaatctttctagcaatgaaataaacagccaggagaaggcagagacagccaaccaagattcctacacctagactcagcatttcacctgggggagataaaggtaaaaggtgtcagcctaggactaacatagattttgagcctttcccccactcggtgaggacacctcccctccccgcattatcttataaggctggcttacctgtggtatacgaggatcctgctgtaagagaagaaaatgggtcagtgggacttcagatccccatcccagctgggagcagcactctctgctgctgtgcctgggagaatcccccgggggcaccctggggtgggggttggttcccagtccaagcaagtcccagaaaccccctccccttttagccttttcttcccattggctccctagttcctgccattgtgtccccctcagtttcccatctcttctgagccgtgcagaatcaccttggatgaaagaagcaaagaccatgcgctgattgagaggctgaagggctcggtagttctgtaccagaagcttagagggctcctcttctgtggagaacaatgtcccctgaagcttttccagctgaggagcagaagcgtgggagaggtgttactttggggagtgggaaggggtctgaagttacaactgtgtctcacctcacctcgtttctccaccacttacctgttccattgaaatctgggaccttctataaaaaactgtccagagcacactctggtagcaagggggagttgtgagcgagccattgtagcggaagtactgccccagctgtttggggagcagctctcttaggttgaagggaggcactgaggtcttctgatctggggagaacagactgggactcatcttcctttcagtgtgccctagcttacctagatagggctcccagaagcaaaattccttggctctatgtaattgcttcatcccaaggcttttaaggatagtttttgaaagtctaatcttacttcctgctatagatttttaaggctcacctttatgcctgacttcatgcaagtgactcagaatgtgttcataagctatattcttagtctcacccacctggaagagaaggaaagggagagagtttggaatgagtccatgtttggaataagaaatttatgtacagaataaatggtcagggtgggctgctgcctgccataggaaggaggccagcaacagaaataggtttgagggttgcagaggaagtggagagaaacctggaagggactgggggctactgacctcaattaggatgcccaggacagccaggccctgaggcctctcagcagcctcactcaagctgtcataggaatcagagtcataatgtacaatgtggagctaaaggaaggaagagggaattgaatcatggaatgtctgcacccccttcaaggccttgatcctagctgccaccatccccccgctgtccccggcaggcactaagtctgtccctcagagattggccttatccccccagcatgacttttcctaaggtccagatcctttccccaggaccacccatccctgttactttgtctgagtcccagctctttgttccctggtacctctgcaaatgtggcttcactgttgatctggtgttctgacccccctggggatcctttctgaccccagtgcaggtggagctgggcagctacatattttcggggaagtccacccagatacagggtagagggcagagagagttgcactgtgaggaaaagagcaaactcggattggtggaggcatgtggatacattcccactcctgggttgccaccacttcttgggagacttggccctcttccagttttctcccccagtagcacccagttcctcccataggccagtgcttttctagcatatcttcctttttcttggtgaagaccaagtcagtgcaatgatacctacctactgagcttggttataaacatttcgattcccgctttggctacaggatcctgatccccattctcatatctccaaattcatggacaaaggtttttgagaattcgtaggttaggaaaatgctgctttcctctgactcctgaggttatttgtttgtttatttatgtcagatgggtaatgtgccaacatcttgacaagatttgagggcggcacatcttacgcatgctcaggaacaccccatcatcatgcccatgaactacaaaaggatctgactcctaagatctgagctggagcctacaactccttggagcctgtgcttttacctgtgtggccattgttgtgcaggtccaaaggctcggtgccaggctggtcatatccgtggggctgcagagcaggcaaatcagggtcaaatgtcacactgtctgtctgaatatcgatgggcgactgggcattgtttccacactcagggtaagaggctggccaatggtcctgaccatgtgggcctggtgggggttaccaaagacattggtcctgtcctccagctctagctacccttcaacagcaccccctccctttgacccttcccctaaccaagccatacatctgtgtggaggtagaaatggacttccctccacccaggttaagaccccagttgtatagggatgggtgaggtaggagtcctgttgagtctcatgctgcagttccccttccctacccagaggcagtgatgattccccaactatcctgatgaatggggagtggtagctcttttacttacctgtattttgaggacaagaaagctgaatgagggcagaggggatgcatagaaaacctgaataccctgagagatgggattagagagtaggagtagaaaaatgggagaaataaaatgatcctagataggccaggcacagtggctcatgcctgtaatcccagcactttgggaggccgaggcaggtggatcgcttgaggtcaggagttcgagaccagcctggccaacatggtgaaaccccatctctactaaaaatgcaaaaattagccagacgtggtggtgggcacctgtaatcccagctactcgagaagctgaggcaggagaatcacttaaacccaggaggtggagtttgcagtgagcccagattgcgccactgcactccagcctgggtgacagagcaagactctgtgtcaaaaaaaaaaaaaaaaaaaaaaaaaaaaatcctagagagatacggtctcctggaggcccctatcaagtggccttgggattcagatatcctgacttctcatcattcacttcttgctctcacactgaccgtttatcatgaacttgagtttggttaagtcattaatcagtagttcataggaactgagttccacctcccccagggtcagaaactatcctgccagcctcttcctcacccctgacctccagctctgtcccaatttcagatgcaggttaggggtaggatggattaggatagacggagccagaaggagacctggcagctaagctcagagttcccacccagcttcctttccaccccagctccctcactcctacacgatttactgaggacttaactagcttttctgccaaatcaggaggtgtaggatttgatgattagagcaggatctaggagccatatatgtgaaactcaaggcaggaggagatccagaagggaggagctagggtgagaaggtaaaggaagtctcctcccacccgcacagtgtgtcttcctgccaggtgaggaggtcccagtgtgaaagggttgtcgggaggccttgagatctgctcaccctcatacgtccagtgttgacctgcaaggcagaatagtttgggttacagccagcgcagcctggggcagaaccctggcctccacactcccctccctctggcattctgtactgctccacctccctctctgcagtctctcctccctctgctccagcactttgcaaaggaagccctgaaaccggacacctctgtggaaaggtcggggggcctatttaaaatcaccagccaggctgtgttggtgcctgccgagtaaaaggggaggaggaaggaaaagaggtaaagcccagagactaaaattaacctggatccaaatgtgcgattggcccaaccctttcttttctgtaacctgtgccaagtcaatctaacacttagaagattggggtgggtggggtgagggtgtgggcagagggttggaaggatagggactagaaagcggggaggagaaaggagtttagagtgtgtgtgtgttggggggtgctactgaggggagaaggggagattattcctttgctttaaaaaattgcatgaataaagccactgagctgtaaactcatatgtaaattcttcttttctggtcccattagctctagaggaaactcctcatcaccaggaggctctgctccctacattctgagatggttagggaagggtgggagtcagggcagggtctactctagattgagggtggtgggtgggcacaggcagccaggctggcagggacaggatgaaagtgaagcattgtgtgtagagaagagagctgccagctgggtcacatgccaggctctcgtgcagtcctgtctgacgcaaaggctgagggtctgcaggtccagcccctccctacggccaaactgcctcaagaagaaaacgaaggccttcatggtttatgctgcaatattcatactactagaaactctggagaaaaatcctaaattccttcctctctctgtctcttattcccttaaattcctcaaacttgtgagatgtcctgctcttatccttgacctattctgctagcccaagggagagctggaggcagcctctcattttaccatatctgtgggaccccccaacaactcaaactccctggtctgtaaaggtgcctgtccactctggtcagagcctcaacacacttattctgtctcttcctcctctttccctctttttttctttctcctcagatgagatttgtgactctccatttggctgcctgcctgcccccatcctctctgcatttgccttctgctctctggacacccacctcaccctgctctttccacaaacctcagttacacacctagtatgtgctggacactgtgctaggcacaggaaacacaaaaatgaggtctaggagttcctggggacactcctggagcgcttcagcctgttctcccaagaatccctcctcatctcctgggagctcctgaaagtcctttgtaaactgtaaaatgtcaaacaaatgttgactcttactgccactttcagaggataactggggagttagtcgctccacagaatgaagagggaatcttggccaaaaggggatgaattggagatcagggtctgagttgggcaggaagtattcttccccctacccccatctatccatctttttactccaggcctctttgactccctatttggaggagtttgtaaataaagaagtccaggagtcctgcctgggaccagggcagtgggggaaagagctctggagaaaatctgtagcctgcaaagagattccagcacttgcatgtgtacacactctgcctgcctgccgctagttctccccgacctccaataacaacaaggctggagagacaaaaggtaaagaagggaagtggtctcctccacaccccactcttttttcctcatctctgagcctattattccagcctctaggcttcctttcacacctctcctccccccattaagcacacctggcgacatgtgaacatcagcacaaatccacacacagacatttagttgtacctacccccatctgcagccaggatccaaatcacctccagcaggagggcggagaacaacatagtgtcccaggaaggggtgcaggggactgggaatttgaggactagaggactaggacaggcagagagagagggagggaggagtgagagagagagagagagagcgagcgagctcctggcgtgagtgtatttatctctgcttctcttgctgtctctgtctctgtgggcttccaggggattcggtgttcagtagggtatcatgggtttctggatccccaggacaaatctcttgctgcctctttgccctctctctttatctccctctgcagtctc

SEQ ID NO: 12719 - DNA, 4108 bp, Homo sapiens
acaggatctaccccctctgcagcccttcaagaagaggtatgattgctaccacttttccccacaaagtgacgaaaggaaacagcgacggaagcgcaaccgaaccctggaattggtgtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggctgcggccgggatttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcagggtgagtagagggcccgggagacgcgggagagcgtcgaagagagaggtgcggaaggggctggaggaactggggcaagcctgggagcctgaattggggacgataagtcggaggtgaagtttgggcggaggtgaggggttgggtctgggagatttgtcctttcccgcagttggtttccaccttccaaggatctcacagattcctcctatattcctcccagcgacgtcagagaaggcccaaggccgagactcgtgagggggctgtgctgacctaggcaggccgagtcaggtgccttaggggaggatccaggaacggatacctcgcccttccgtgctcgcacactctggctgtcatcgctctgaagactctttaattagatttctcccctttccagtgcgttcacttttctacagatgagtctcttggtggagacagttaccctacctggtccatgtctccctaaccatccggaaggctaacttccacttttcaagcagctttggctggtttccctccttgatttctctggctcccactactattgcttgtctcactgcccctgtcttttctcagggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagtaagaagatggagtggtctggaggggagaggggcaaaggactgcactatgggaagtggggcagcccctgggtgctggtttggaagaggaggcactaagggaggacattagagggaaaggagcatccctgccctccctcatgtttcccctaccccaccccaccccaggaaggcagatgaggggttagcatcgctgagtgaggacggaagatcacccatctccatccgccagatggcctatggtgagccaagggagagggactggaggagggagttggacagccccctcctctagggaagtctctaaatatccacatgttctaagtggcttcttactttccttcatccgtcacttccaaagaaagttggtctggagggagagtagatgtgaaagaattgtaaccgggaatggggaggggtcagtggtgaacaggcaatagtgtgatctctgacattgatgagatcctcccttcccccagtttctggtctctccttcggtatcatcagtggtgtcttctctgttatcaatattttggctgatgcacttgggccaggtgtggttgggatccatggagactcaccctattacttcctgacttcaggtaagatccaccttctatctagcctttaccccccatccatccttgtccctgatctgatttattggccttccctgagagacttctttggctcaacatctcaggagcctgggagaagatcagggatgtatctcctccccatctccctccctgcagcctttctgacagcagccattatcctgctccataccttttggggagttgtgttctttgatgcctgtgagaggagacggtactgggctttgggcctggtggttgggagtcacctactgacatcgggactggtgagttggagacaggggcctgagttagggagaaaagcatttaatggtgagtgggatgtgggggaaagggtatcctcacttcttaacatttttaacttacctgggaggaggaggaaaggtgagtctttcaaggtctctcacctcagcatcatttctatcacctgctctggggaggaggttgaaaggattagtcaaactgtaatgcagagggcctgaggtgagcaggagcggcagaaacctttgagtttctgaggagctgaaaatcaaaagtccccttaaccacaagatgttggtgctctgaagggaaagactggagaatttgagagagatatctgggagtcagaaaggtacagagagaatatggggattaggtcgagggagaatctaatctctttcctactcttaccctccttcctagacattcctgaacccctggtatgaggccagcctgctgcccatctatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaattgtgggggaacttggcttttaagggaggggatagcatgttaattgagatttctgtcctcagatctctcatccagccactttcctaacctggcaaccactgatttccaagcatagccttggtgcaagggcagaaatctgggctagtggtttaacatgtctgaaactttgggttaagtgtcttcccaga

SEQ ID NO: 12720 - DNA, 634 bp, Homo sapiens
cagagacagagtcttgctctgtcgcccaggttggagtgcagtggtgggatctcagctcactgtaacctccacctctcagattcaagctattctcgtggctcagcctcctgagtagctgggactacaggtgcgcaccaccatgcctggctaattttttgtatttttagtagagatggggttttaccacactggccaggctagtctcaaactcctgacctcaagtgatccagccgccttggcctccgaaagtgctgggattacaggcatgagccactgtgaccagcctccgtgtaaatctatacaatctattcctcagctcctttccagaatatcctggaagacatgtaaaacatgtatgtgagtgtgcacatatggattaaataataaatcacttccaggaaggaaaggaagtttggttatctttaaacaatttctgtggggtttttttttggtactttgattatgctttcaaaaacaatattccagatttctttcctcttttccatcctcagattcctttgcctaacatcttccctaaggactaacctctccccatccaaatgagattacaataccctcctctcctacttaactttctttttcttttttgagacagaacctcactccgttgccc

SEQ ID NO: 12721 - DNA, 156 bp, Homo sapiens
ttattattttgagacggagttttgctcttgttgcccaggctggagtgcaatggcgcgatctcggctcactgcaacttccacctcctgggttcaagcgattctcctgcctcagcctccccagtcgctgggattacaggcgcccaccaccatgcccag

SEQ ID NO: 12722 - DNA, 4307 bp, Homo sapiens; identical to SEQ ID NO: 11736

SEQ ID NO: 12723 - DNA, 552 bp, Homo sapiens; identical to SEQ ID NO: 11737

SEQ ID NO: 12724 - DNA, 481 bp, Homo sapiens; identical to SEQ ID NO: 11738

SEQ ID NO: 12725 - DNA, 2610 bp, Homo sapiens
ctttcatcttttatgttcaaagtacttgatgcacaaagcctggactcttttatctctgtcctatagactgatgtctagtcagtattcattgtgacaaaattgtttcattagagcaagttggatagtgtatggagattattataaaatgatttaacttgtcttctgtcaagtaattttataattggtattaatgttcatttttttccaggtaccagtttcagaagctttcatttgtgtatgcatgtgtgtgttaaataagtgtattagatacttgaaaaatagtaatttaaatttaaacaatttaaaaaatgaaattgtaattttatgtgtaaaggtgtctgatgtgctttattctgcactgaaaacaatattcatttacagctcaacagacaccaaatatattctaaaattactttcctagagttatcagaaaacagcactgtaataatgaaatcaaacccatctttctttatgatttattcttagtctgatacgcatcagcctggtaagccttcctgtctctctgcttacttaccaatcactccaaatgtcatgtctttgggcaggcattaaattcttgggttttgggttttgttggatggactgcagtctgtgtgagcctatatgggtgtgtcaaatccagtctttggggtgtcatggaaacttagcatgatagacttgattttatccccaagttgacttggtaatttcattagatttcatcagtcacaacctgcattttatcttgtatgtgctgtctattggtcacaaaatcagaaaaccttcttgtccattcataacattagctgttttttcaggtggctagagggacatgtcattgcttcatctgcatgaatttgaaagattaaatgcataaaggaattttcttagagtagagtaggccttcaccatctctttaactgggaaagaagttttgggagtaacatactcatcactcacacccccctcccctcaaacacacacactcacccattagaatgtaagggccttgaggcaggccttgtgtttgcttttcgtgttcactgtcagcatttagaatagtgatagtcatatagatggatagtgctcaatcaattattgtcaaataaagtaatctacttgttccttgatttagactagcaaaaggggctggtacattgtaggtacacagtaaatatttgtagaacagatgaatgaaccaacccaacagatttcttagaagtagcctgcttttggttactaattattttatagaacatataaaagaaaattttagaatacctaatttgttcacaaaaatgttatattgtctcccctgatacttggtattcctgtgtcaggctgagcactaaggttatacattttttgttaagcatgtaattactgttatttctcatgtactttattttgtgtattgatttcagtagttgtagctgagggtaatccttaagagcatgcagattttaaaaattacatagattgccttgccaagccgtctgaaagtcatactagaaaatttgataagagcctgctgttaacaacacattgagttatttttatcttaatgctaagtggagaattacttgaatttattttttttgctgcatttaatgttttgatacattcaataaataaggataaatccacttactgaaggacaagaaaagatcaataagagatccttgaggttattgggttctatggcatctattatatcaaattccttgccctttcactatactgagaaatttgacgactgggctagcaacaagatacctaccccacattagctgtggtacctgctgaaatgtgaccatgtgagcaaagaaaatgagccaaaagaaactctttctgaagattcactgaagaaaacctggagatactctttcattagtagaccccacagagacaggtggagtgtccgttatccagaatgcctgggaccagaagtgttttggatttcagattttttcacacttgggatcctcaacatgtgtatttgttggaaatggctacttaatttaaggaaaagtttaaggtggcctggaaaataagtagtagttgaactaatcaacaggaaccaaaactactttcaatatatagtgtacttatactcaaagagagacggaccattttatggtggaaccctgtctatggtagtattttgtgatgttttatttttgttgctattgtttgcactgttttctcctataacagctcttctaagccttaagaggataaattttatatgagattcaaactcttatttttgttaagaaggatgtaagtcaccaggcatggtggctcacacctgtaatcccagcactttgggaggccgtggcaggtggatcatgaggtaaggagctcgagatcagcctggccaacaatgtgaaaccccgtctctactaaaaaaaaaaaaaaaagaattcaaaaattagccaggcctggtggcgcatgcctgtagtcccagctactcgggaggctgaggcaggagaatcattgaacctgggaggcagagtttgcagtgagccgagattgtgccactgcactccagcctgggtaacggagtgagagactctgtctccaaaaaaaaaaaaaaagaaaagaaaa

SEQ ID NO: 12726 - DNA, 16423 bp, Homo sapiens
tttcttttttaagcacttaaatatagatccggtggtatggatgagaaaacaattgctttacttgttgctggactagtgatcactgtcattgtcattgttggagccattcttttcgtcccaggtaagatgtgcagttcctaggcaggaacgcaggaggtagatgagtgcattccaaggtgaggagggctgcattagtttcctagggctgttggaacagatgaccacaaactgggtggcttaaacaatagcaattccctttccatgctggaggccataagtctgaaatcaggacgtcatcagggccacactccctctcaaggctgtatggaagaatccatttcttggctcttctagcttctggaatttgctgaagaatgacagtgtttatcattccttagtttgcggcagcataactccaccctctgcctctctggtcacattgcctcctccttcctctatgtctttgcctctgtgtttttgttaaatctccctcagcctctctcttatgagcacatttgtcattggaattagagcccactcatataatccagggtaagctcctcctttcagatccttaacttcatcatatcttttgccatataatgcagtattcactcttttgctgtattaggtaatattcacaggttttagggattaggaggtagaaataattttagggccatcattcaactcactacagaggcaaacttcattggccaagacatgaaagtagaatgaatgtgggaaccaagtctggaaattggcagttgcatttggaggatgggaatgtgagtgggaaatgaggatatgtagcacatgtaaagaaaagcaaaggaaggctgggactcaacctaataactatagcacaccatcgtttgtggagaagaatgcagtgcaggtgtaatatttaggaacatgggcttggcagctctattggtatctgaagttagtgaagacagcaggaagaaggaggtgaattcagaagacaacttgaaggaacaattgatttgactttggggcatactgaatacagcagatgaagggaacagtaaaagatgaatacacagtttctcactggaattctgtaaactagttaagaaggaggcagagccaattcaaggtttcagcatgttgaaacttaaatgttgagatttagatgtcttaagtttggtcttaatcaaaaaatagtcactaattttgtgtgaggttttcagggaaacgtatatttttaaaattttcacagttgtcaagcacagaatttagattagtacatttaaaaagtatgtaggaaaatattttaaatgtttttatttattgacaggtgaatattcattaaagaatgctactggccttggtttaattgtgacttctacagggatattaatattacttcactactatgtgtttagtacaggtgagttttcattgttacagtatgattttgtctacctttttcatttacaaaacagcagttttggtgaaaatgctcatataaattttttacaactcaataagagtaggtttattaaaagatttttcatgctattcttagtgacattttcccattcatattaattttaaggttattctaggttagctgttttgtaaaaagtgactttcatatgtatttgatgccaatcagcataattttaaattatgccatataacttcttaatgattattttcatattctaatttcagttttttgaagttataagtggatgttaaacgcagtctttctcttcttttgctaagcttctgcttctgcattaagaagactggttctataaaatggaattatgaatcacaaatagtagaaacatatttgttttaattattagcaaaccttaatactgtagttttaagagatggtatggaaatccaaactataatcagtatcattttcactgcattttgaaagtagatcactaccatatttagttattactattaaagagtcacatttaacacttggtcttagagcctatctctggctcgttgtacattggaaaggtattagtttgttataaaatgacatctagagatagagagcatgatgtttacagtcaggtatttgcataatggttccctcagcaagagcaattccatgtgcatgtggagaagacattcataatagccattcatattgtaaaatgcacaagtgtggtaaaagcagcattgttctaagatttagggtaaaaacttccagtccagcttagctgactgtgaaaattaaaggctgccgaatgtgtgaatttggagctgactacttgtgtggaagggttagatcactgagttaacatctaccgtcaaacaatgaactccagagtcagtctttggtcttaggagatccctgattataccaaatgcaagtggaagttattgctttttaaatactcttgacatgcttctgttacatccttttccttcctccagcgattggattaacctccttcgtcattgccatattggttattcaggtgatagcctatatcctcgctgtggttggactgagtctctgtattgcgggtaagagtcatctttctgtagacctaatttgggttacttttggacagagctcttcttcctttttctttttctttctctctttttaaaaatatatagacttgatttttttttttagtgcagtttttggttcatggcaaaattgagtggaaagtacattcacatggatatttttatgtggacataagttttcaattccatttgggcaaataccaaggagtgcaattacgggactgtaaagagtatgttgaaataaactgccaaactctctgtatcaaaatagctgtaccattttgtattatcaccaccaataaataagagtttttgttcattcatatacttgacagcatttagcattctgagcttttctttttaaacttccaatttaccccagtggtaatagtgctttcctcctcgctacaaagatattagctgtatatatggcttggtggctgattgttctagcacccaaactgatatgcctgtatttgtggaagagcttttaaaataactgggctcaaattggttggagccttagacttgaaacaccagttcccatttcttgatatgataaggtatgtgttatgcaaaggagggctttgttcttctaataattttgagtcattttactggttaagttaataaacatatatggataatttttgttttttgatcgttagaataactctcttaaaacttgggattattactgttttttagtaagttatttcatatgcttttctaatacagaattttatttgtttttacagcgtgtataccaatgcatggccctcttctgatttcaggtttgagtatcttagctctagcacaattacttggactagtttatatgaaatttgtgggtaagtcaatcttattttcattaacctatgccaataatttcagatatatcacttagaaaatgctttttagtttgttcttccagtttaggaccaaaaatgagaaaatacaattggagtgattcgaggataattaaagagggtagaagacatataggatttttagttggttcttccagtttaagaccagaagtcagaaaatacaattggaatgatttgagggtaattaaagagggtagaagacatataggattaatgaaaatttggtttccaaagtagtttaaaggaaaatggctttatctattagaatgtgtacctttttatactaagtaaaaggggagagatctttgaggatccattttaagtaatagaataggatttttaattgttccagtgtttctgtgatagagctgtcctgcacagacctgtttgtttgtcacttgctctttttcttgcagacatagacaccccagacaggaattaaaattcacaatctatcaattttgttcatttaaagagcagtgacctctaatgcatgactttaaaacagttctagttaaaaccaatataatgaaaacattgagtttcaaaatttaggcttttactccttttaaaatcaattattagtaagtatggaatttacttcattgtttctaacttgtatatttaatctgccaattttcaagtaacatttctgcataaattcttattttttattgagatatatgtacacagagagatattttcaattgtgcctgaaactaatgttatcttacctaagctcaagatgttcccaataatgtaatttatattagtttccgttttttaaaaaaattatatttttatgaaataaaacatactcttaaccacctatcaaaataatcaaaagttataaattaatggagtaaaaaaatagtgtttctgctttgctttaggtaaactttgctgtatgtgtttctaaaacttaatacgaaacttgaattgttatagtcaaataatttctcatatgactcacataatagtttcaaaaaacttttacctttatttctgaactttggttcttgatgattgttaattgaattcaattctgtcatatattctgtgtctttctttaattaatgcttattagataaataattaaaatacttaactaatatctgcgtatccttagcatatgagttcataagtcttagttgttgctcaatgaaattttctaattttataccacataatgccataaaatacaatggagacatctaaagcagaatggaattcatgtggtagctacagtgaacatcttgaatgttggtgcatattctatttttgttacatcttccaatcaccatgtgtctggttctggaagatgacactcctggttttgttgctccccacaaatgcctgagaatagtgtgtgatttgcagtatccatacaactctggtgaagtagtatgagatacctttggctgacgggcagcacgctcttattttttcctcactatctgggttgtcctcccttttactcccatgccaccccatgccttccatatctagcatagaatgatcttcagtacagttgccagcaggtctggtgacaatgtctcaagtggaactaagcattgtctatctgccacctccttaacttcactctcctgccttctccatcacttacgttcctccaagcctgtgaaaccactgtactgtacctgtcactgttctgacattaaaattaaaatgacttaaatcttgacaagtaccccaaattattttttctttgtcataggttagcatataagtatactatatgctaaaatttatgctatatgtttaaaatttagtgcaattttattgatagtgtcctaattttattgatagtatcctaaattaactttttaaatcaacttgtctgatgccagggttcagagggacacctacagtcagttgaaaggcaagaagagacaaggtacaggaaagttgctctttagataacatggtagactaggaggaacattaatatggtttgcttatataatctgactgtgtaaatctgaatctatgtaacattaaggttgcaaatttgagcgtttatattaggaagttaaaattttaagtgtctccaaaataatttttactcattgcacgtgttctgttttagaaaagcctaatgattgtgttttgatttaaatgcaataaaatcctcaaatagttaaaaatccaagctttctcttcaagaagaagttaatgtcgctatgagatttttaacttttataatttttattatttccaactttaaatttgtagccttaatttgctattttaaagagtaggcctttcactttctacaactttctgtgaaagtgactttcactttctattttttaactttttaaactgtgttgtattttttttcttttattggaagcattttaattttataagatgagaaaaaggactgggcacaataacttaatgtgaaagcatagaaaagattacaagaacctaaccaaactcactaaagttgggcttgttgtttgtagagaacgtttatataattataaggatcaatactttctcatttttaaagccattaccagttagttcaatataagggcatatagtgttttgatacaaatcaatctggtagcagtaagtaccatatttaccacaacatcccagatttttagaatgatgcatatgcagaactatacgtagaatttatatctatgtatagatacatattcagatattttcttgttcaatttaaggagaggtaaatttggtatcaatagaaaaaatgtttctgaaaaatttaaaccctggaaatgtatttatggcatggagtcagatgtttcagggagagaagaacaaatcaagaagcattgcaagtatgctcatatggaatgcttaaggcttgtggttaaaaaatatatatatatggctgtcaatgtcttaggctcatggtagcagcagaaatcgtaataattcttttgtcacatgggttatatccatattggagagaattaactcaggtgaaattaacttgtacactgtttggttttataatatttagagggatcacaactgactgatgtccctttgaagtaccattcttcataaatctttttttttcagaatgggccagccaactgtgacatcccttggatcggagatttagaactagaaagtattctttctacattattagggaagaaaaggagttacttggcggttagcaatattctattttgttttgttttgtttttagagacagggtctcattatgttgaccaggctggcctcgagctcctgggctcaagcaatgctcccacctcagcctcccaagtagctgggactacaggcatgtgccactacacctggcagtgtttattctgataaatacatttatgagctcaaaaatgtaactctaaaaccttatctctgaacttccatattaccatcagaaatttagatagttgtttagttctctttttctttgtagaacatagatataaggcatggtttcattgaagtcagttgtatatacatgtaactatcctgatgttcccaaataaagctctgtatttctgcttagtttattggggaggctgctaaatgtagtgcatcccaacccattttaccctgttctactttaaaaagaggttggcttcttgtttggatacaaggaccaagtcactcccccaggttcctccacagtaagggaggcctatttaaagccgcccatggcactaacagaaactggactcctatgagctcagatacataactgggcctcacaggggtgggacagtatgtagtctaggaattggaaggatccattccatatcaaagaactgaagcatcgtgttgccctctcagcagcaagagtaaggtgatgcccctgtcagttatagttcctgagttcctctgtctttgattctttgcctattagccagctagctcaccctcttgtttatgccactgttttttatcctattcatgccttctcacagacaacttttcttacctacagctttggactcatccttgtctcctttctgtttctttttcactttcccttcccatcaccaactttctgggtttttttctgtttcttcttagagtccagtggcagggagaaacttgtcagtccagtctgttgccatttttcctgtttgagaaagactcaccagcttttggctggctcacagattggctttccttgggtcaggacccacccttttccctgccagctttggaagcttgacagaattcgagtgtgcagtggtggtaaataaatagtaaggaacacagagcagtcctggaggcgtgcctccatctgctgatgagaaaatccagtgctgtcatccagcccaggtcccagcggaatgggcctctctgttcagtaggatccccctcctgctgagtggttcatggcatgtttctgttcaacgcttttccatctgtaggattcttattctgtatttatttgtttttttgggtttttttattttttgagatggagtctcgctctgtcgcccaggctggagtgcagtggcacgaccccagctcgctgcagcctctgcctcccaggacgagggagatcctcccacctcagccttccacgtagctgggactacaggcatgcaccacaggcatgcaccaccacgccagctaatttttgtatttttggtagagacagggttgcatcatgttgcccaggctggtcttgaatgcctgagctcaagcaatctatttgccttggcctcccaaagtgctgggattacaggcatgagccaccacggccagccttctcatttgttttttttataaggaagctatctcttcttccctccccaactagggtattctttttccctttcgtcactttgctcatgtactgtattccttcaacttcattaatgaatccatttggaagcagtgaaaaaggcaactcagaaagctaagaagaaatagatagaggaatactcagagctatctgagtattttctttagtttgttagctctttggagctttgaaactggaaagacccagggagtgatgtggagaaagagactgagcttgtaagacacaggagcagtgagctaagggagatggagtagtggggacaaattctggcacattctgtctacactctgggtagatagaggagggaggatggagcacccatggtgggggtatgttggtgacagcattttcccaccagccagtgtaacaagtggctgatttgggggaaagatggcataaacaaatgagagaatgtgtttactatttgatgtagatgggttatttgcttcatttttcaaatcagtgtatataatcaagaatattcagcatgtttgaatagactgtcagagctggaactctttcattaacatctctggcacctttagttttagccctgaacattttatcttaaaattaaacattaccaaatgccttagtttatttcatttattaaatttatattcttatttgttatttatatcagcttccaatcagaagactatacaacctcctagggtaagttaaagtttattaaatgaattgtgaatgatcatttgagggattagactgaggaacttggtaattgagatattttgctatctgttttgtctcacgtcaaattaagagaatgttgaagtcattgcatgacctttgcatgaatgggtccagttctattttaaaacctgtgtttggtcattttagtgtcaatgggatggaataaatgatttcttaagattgtactgacttctcacacccaaaactggaaagtaggaataatggctatattatctctgcaatcagaaggaagctgattccaatatatcacctcacctgttggattcattggatgtgcatacacagaatgacaatttcaggcttaaaaatgaggagaaatctatactaagttgacatcactgataattataatctataaaataaatgtaaatattgctgaaaacatctgttcggagttatgattcgatcctctcccatacaaatgttttataaacattttttcccttaaaactgtgcttaaggtttcattgtaccttagataccttattaagccatctgaggaaattgcaagaaaggagtaattttaggagggcataaatgaagagaaaagcatatttataaacatagacttatcacagtgacaggcccaagaggtatgttgtggacataagctctggaaaggattatattgtacttagcttcctataacggagtgatgatagatgtatctggaatgccaaagagagtcttctgtctgtggccggaggtagaggtcacatatgcttctaagtctgacaagcctcattgtgcctaaagggcaggtggggcgggtatgtgtgtctaccacaggggtatattctagaaagattggtgccatagctatgttggtcacaagaggccagcaacttaactggacctgtgaatcctaacacattttctttcccagttactgagttcaatttgcgatacttaaagatgattctgttttgcttccacctcttcactgtgttatttattctgttgttgctatttatgcttgcactttcatatttttagaagttagaatttcttgagctgagagtggtgaagtgggaaattctgtttagaaaaataatattaagagaataatacagttattattaaactattaacccgactaaacaagctttgctttaacatttacaggcttatttcgttgttttgttttttcttttttttttgactgtaggatttactgcttactacgtaatttaaatattagcatatataagttttactataaaatgacatgacataaattatatttttatgtaaatatattttaaatatttttcagaaagctgtagaggaaccccttaatggtatgtggttatttcactcttaatcctttaccagatcataatttgatctggcccgcaaaacagttagaatgccctgtctatgccttaggaagaatctaggtttttttcctctttttttctttccttggcatctctactcttgattattcatcaagaattatgggctgggtgcggtggctcacgcttgcgatcccggcaccttgggaggccaaggcgggcagatcacgaggtcaagagattgagaccatcctggccaacatgttgaaaccctgtctctactgaaaatacaaaaattacctgggcatggtggtgtgtatctgcagtcccagctactcgggaggctgaggcaggagaattgcttgaacccggaaggcagatgttgcagtgagttgagatcatgccaccgcactccagcctggtgacagagtgagactctgtctcaaaaaaaataaaaaagaattatgaatattacttttataatattctcaccactgggaaaaatgcactattctgtgtctaagtagctgcttaccttaaccaagtgatatttgggcaaggggatcgttgccttttgctactggttgagacgaagcatggcaccccctagtagagaaggatcccaattacttccaatttgtgatgtacacattttagaaagatacaggctattgccacagagatagaccaaaacatctcattttctttctttgtaaacctagatctgatttcccaactaagtctgtttcctttgtgaatgctgtgggtatgatccacagaaaggctacataatgaaatgatagctttacaattaatttggctgtagagttgtagactagttagcatatcattgcatatttgtttatttagaaatgatttccaattgtggaacctcactaactgcctgcttggcttgttactaatcctagcattcaaagaatcaaaaggaatgatgaatgatggtaagtataaaatgcacttaataattatagatcagttaaaacatggacattggaaaacaaaaaagcttcttgaaaatgtggctcttttttagtaaaagggacactgtcagatgataaaggttcacatttcttgatgtatacaacttaaatctactttgctaaaaattgcaaaactactactgtaaaaactgtagggtgtcacgaatcagactccagtcatatggctcccagcaaagagaaattaccactttttgtaaaatgtttttcagattccgtgtctggtgactgtaactttaagatgccttttataaggcacataaataatctggcacaaatctttatcattttgacagagtttcttttatgcttgtgttggtgattttgttgcatttaacccatggggacttaacatctctgcttttccaatcaggagcttggttctaaccttttgggagatgattaaagagagaggttgagagagagagagagagagagagagagagagagagagagagagagagagatgtttcgtcctcagcttttgcttccattttttttttaagaactctgggctaataacttctaatctttatagaatatttcaaagaaatatatttgttcttaaagatacataggtttgagatattgagtgctacaagcatttattttggttttaccttaacatattatgattcctcagttttgttggcatttagtaattatgtttatgtttttatcttatcaaaaaatgtcttcttacctttgatatttataatcactcctcggtcatgtaaatagtttgctttatattttactgttttaaagtctgtgaccttacctgccctcttctgtagcaaagtgcagcatttaactcaggaagctatattccccccaagtgtcattaatatttgcataagattaaaaacactccagtcggccgggcgcggtggctcacgcctgtaatcccagcactttgggaggccgaggcgggcggatcacaaggtcaggagatcgagaccatcctggctaacacggtgaaaccccgtctctactaaaactacaaaaaattagccgggcatggtggcgggcacctgtggtcccagctacttgggaggctgaggcaggagaatggcgtgaacccgggaggcagagcttgcagtgagccaagatcgtgccactacactccagcctgggtgacagagcaagactccgtctcaagaaaaaaaaaaaaaaaaaaaaaaaaaaaacactccagtcatgcattggtgaacaaagtttaaaacaacgtgtattcagcatggagtcacagaatgatcctacttttgtatgtttgtgtcacagcctttaaaagcatgtcttgttatataagccattaccctcctaaaaaagactatagttcacaggaataagttaaaagacataacaaaacataaaatgactagtaccaggaattgtgaccatggtttgttctggtaactgtggcatggcatggtttgttccaggaattgtggcatggtttgttcatgtttacattctgatgtcctattttttttttttaatttctatgtcctttccttttccttggtggtgtcattgttctgtagctgtatgaagaaactaaacttttctccattttcaggaaagcaatctaagaatcttgagtgcctcttcctttgttaatttctcttaagatgtgacttttttaaactactgcatcaggaaatattgtaaaacagttttgccttgaatatttgtgatgaaatctacgatgatcttcaagattctcttaattttgctaatattcagctgatcagaatttgtttttaaaatgtctggctggtgggtacttcccactgacaactgcttattgcttacagtatgtctgccttgtcaatgaatgaggttcagggtgcttcctagggatcagagtcagtaccatttttctctttcatctacagctgatcagatgtttattttacttacattaaatgaatgatggagatccaaagtgaatattatagaatattattctaggatcaacatcttttgctttgaaaaatcaacatctcttggcttttcctcagccaacccagcaaacagagattatcagactctgttgattttttactttcatttggcattggcctttttcttactgaaattaaaaaggctaatgatttgcctggtttctgtctctgacctttgcaggtctattttcttaatttttagatactatatatctgaaactttttttaatgtgtcaactttttaatggatagaaaatagacacgaatagtgattatgtgttcatttttcaattttccagaataactgaagtgaagtgatggactccgattagaagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttggtttttt

SEQ ID NO: 12727 - DNA, 142 bp, Homo sapiens
  misc_feature (26)..(26): n equals a,t,g, or c
tttttttttttttttttttttttttntgagacggagtctcgctctgttgcccaggctggagtgcagtggcgtgatctcggctcactgcaacctccgcctcccaggttcaagcgattcttctgtctcagcctcccgagtagct

SEQ ID NO: 12728 - DNA, 9903 bp, Homo sapiens
gtgatggtccctttggttttggtgcctcttccatgagcttcagatcagaactagctatgtggttccaggctgccttggtttcatcccttgtcttgcctacttcacctggctcaggagggacatcaaggaggaagaaatggataaagtcctggagggacttcaaacagtatttgacccattccagccgccatgactcccaccagcttcgcagcagcaatgccttcctctttgatgcacaggaagacccctctgctctggatatagccagtgagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaagtctcaagtacaggtccctggtgggtcaggtaatttgctctgttcctgtcctcacctcagtccctctggccccaactggcatctgcaagccagtatactcaaagctggccagaatgaagagagtgaagagattatggcagactctctgccactactgccacacatgtacaaatccgcttaacagatctccttctttaaaatgggacatcttatctttcctgaaatatatatattttttgagacagggtctcttgttctgtcacccaggctagagtgcagtggcatgatctcggctcaccacaacctacaacccagggtcaaatgaccctcccgcctcagcctcctgagtggctgagaccacagatgcatgccactactcccggattttttttgcctttttggtagagacagggtcttgccttgttgcccaggctggcctcaaactcctgagctcaagcaattcacccacccctgcctcccaaggtgctgggattacagatgtgagccaccacacccagccttcctgaaatattcttgataattatagttcctgaacagttttcccaagctgttctagccatcccaagaatgttggcaggcttctccatatgtttggaggtgtaactataatggttcctgggtttcaagctccagtctccatctcccctcaggtgcttgctttcccataagtttccatctgactactagaatatcaggggatttccataaagacaagactttgatcttggcaaccctttggtaaatagccagggttctcaatctttgtgcagcaccaaggtatttttaagatctctgttagtttagtctcagtgttgtaattcaatctaaataaacaacgaggctatctgctggagaaaaggatgaatctaacagcaatgccaccagcatgccctcttcccagaaaaactccacgctagccattggagcttctttaggtatataagagccctttaggttggtaacctcactggtgtgtgtatagattaaaaccttgacctatatctcctctcccttacttgaatgtttgactttactttgggggcaaaagtttggattgttaggggactatatgctttatatactcttctatgcaatagaaagagattgtattaattcactcattgagctttcacagtaatataaaccatattaggcttgtcattctgtcagtgatgggtgtaagtttgtggcttttattactcataccatcctctgacaaaggcatcctatttctctttccaatttcacaataaggtgcagaagaaggtctttaccatctgttaaagatgttcagggccgggcatggtggctcacacctataatcccagccctttgtgaggcctaggtgggtggatcacttgaggtcatgagtttgagaccagcctggccaacatgctgaaaccccgtctctactaaaaatgcaaaaattagccaagcatagtggtgcatgcctgtagtctcagccacttgggaggctgaggcatgagaatcctttgaacctgggagatggagtttgcagtgagccaagatggtgcctctgcactccagcttgagtgacagaatgagactgtcaaaaaacaacaacaacaacaaaagatgctcaggagagatgttttgtagagaggaagatattccctagtacccataaatcatctcaaggaggtggtcatatctttcctagtgctagaaaagccctattcagaaaccttcagtgtttttccacctcctgtcaacctgccttatacttcctgtatctccatgtgggaggcatccctgtggagtttgcttagcacttggccatgctttgtttgaaaccttaaaagctcttaaaggaagttgccttatgttccctgatgagaagatgaagttggcaaaagaatggtgaaaggcagggatcttgatgagaggcccctgactatccctttagtgatcagcatcttcatttcccgtctcattccatgtcctggtggaatggctgcagaagatgagatccagagacagcggtagcacctgaaggaaacccttttcatcaacaactgcctgtgagaaaagctggaatgtcatctcagcagctttgatgaagaaaatggtgggagaggcccaagtcagtgcttctggcaatatgtatttttctaaaggcatgtgactggggcagagttttatagatttcaagcactttgacatactttacttcacttattcattacaaatgtcccagctagagaggtagggcagctactatcattcctatttataggtaaataaataggcttaaagatttgcctccaacttagaggtatctacctctaaaatcattcttgtgattcctaggctgtcttctgtcttctatctgctgctgtacactgcctgctgtctctctgcttcttatgtgattggcattcagtagaacccaggtttctgagcacctcatgtagcagaatgagagtctcctctgctgccatactcatcagcttcccttatgtctcggttactcttcattctaccaccccaaggtggttctctccaacccccctcctcttagattgttctcacacagaggccatcatttcataacattgtgctgggccggaagaaccataaccaggtcccttcccataccaaagcagtaactattttggaaaagcctccttcatattgcagccattggacatgataatacatgtgatgtgctggaatttgttaagaatcatgtgaaaattaagcttctgccccatcgcactaaagttccagccctgagtccccatggttttctccctaggctaagatagagaggaagaacatgaaatatgcagaaagcattctcttaagcaaacgtgtataatttgcctaaattgtaattatttcctggaacagcatgcacctctaaactctacaggcacatcatagattccatcgtccagctgtataatgaaaacagagttctcagagaacaccggagactcccccgacttgcctgaatcaagtttctagaggtaagcggtgaaaatccacaatatgaagtcactctcagacgggtcccttctcttgtcacactccactgtagaaacaaaagaggacggggaagccagagctgctcaaaaccttataacccacaattgtcatagttattctcaacttacacagggctgctttctagacgcaccccctccaggcccccagactgccaggctccaggaataagtagctctgagaaatatagtttttcggtggaagccacactccactattgcaaattggagaagagaaggacaaacttaaaaggtgaaaagatttaagagaacaacatggtgaaaccccatctctactaaaaatacaaaaattagctaggcgtggtgacatgcacctgtagtcccagctactcaggaggctgaggcaggagaatcatttcaacctgggaggcggaggttgcagtgacccaagattgctccactgcactctagcctgggtgacagagcaagactccctctcaagaaaaaaagaagaaagaaagaaagaagaaagaaaacaattgttttagttgaatacattttgtcaagattaaatcaactttcccctagggtactgatagaataagcaatcataatttagattctaacttactggtctttgagaaattgtgaaaacaaaaaaggtgccataagccaaaaaaggagcaaaagtcctaattttcaagctgatgaaaataaagaatgaaaaatattgaaatcgtcatagttcatcttggtccttggcaaaatacaaatctattgattgaaaatataatatcctagctaccttattgtgcctagctcttaccactgaggagaaaaaccaaacgcaaacaaaagtatgttcaaattggcaaaaatgtttacaaacctgcaaaatctcttcagcctatccctcaaactccagacttggtatttactaagctctgctgtgtacaatacccaccttaatatccattcttgcacaagttctgttaggtataagccaagatcacatgggattttttttttttttttttttaccctctcatgcctatgtctgcttttgcttccaaagacccttctgagtaaggactgtcctcagactactggagtcatttagtcacaagcttgcctgaggctcagagctggcaatacctgggagtttatgtcaatcccacagcacccagcaaccttgcctgcaaattatttacccatgattgacaggtgcaggtgtatgaaagtccagctccttgacttgaggggtgcctttgtggtgaattagctttgggaaaagggaatccagaggccaactttgtaaaactccagatagataaatggaaagaaatctttgccttggaagtccagttgagaaagatagtgatttacttcagactgtggaaagagagactaaaatctttactttctcatgggaaagaagcctatggtgaaagagaaacaaagagaatggtgggaaatagggtgggtctactcagtagctttaaaccattctgtcatattataaagcctggtgaggttttaacacaagtgcctggactctacacctagagattctgatttaaatgcttccaggtgggtggaagccactagtagtcttaaaaagctcccaagtaattttcacatgtggctagagatgaaaaggaccatctatctattagaatgtcaagtcgccaacatagaagtgtcccaaatgtacagctacctcatagaaaaggcttaacaccacccattgatggaattttccttcctctcgccatggttttgtttgcatagcatggaaaaaagagaagagaaaaagaggtagatggatagattgaacctataatttgcctatgtagagcagtttctcaaacttatctgaccacaagatgcagtgagaaatatacaattctttgtgatcagtttttaaaaaatctttcattatgtgtaatccaaccttcctagtatttaaataaagcctgtagtagcaagcagtccactatattgatttcacaacccataacttgttcagaattgcaattagaaattttttttggccaggcttggtggcttgagcctgtaatcccagcactttgggaggatcacctgaggttgggagtttgagatcagcctgaccaacatggaggaaccccatctctactaaaaatacaaaaaaaaaaaaattacctgggtgtggtggtgcctgcctgtaatcacagctacttgggaggctgaggcagaattgcttgaaccctgggggtggaggttgtggtgagccaagattgcaccattgcactccagcctgggcaacaagagcgaaattgtttcaaaaaaaaaaagcaaaaagaaaagaaaaagaaagaaaaaaagaaaaaaatttttttcacttctgctcaacctttttatcaagcaaaatctcaaaagaacatttactgtaaaagaacattgacaacaaacatctttctgtgaatccttatttctgtcccagccaccatgacccaataatctctagagcctgttagtgttctccagattgaagccttccctctaactgctcctaaatctgtgatgtagtggaaaaagtttgaggccttgattctcatcccaggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttaggagggttatttctctgcaaactatcctctctttcttatgacagctatttctgaatgtgcacatttgaggctaagcaaatcccttcctgggaggcgtgaaagacctttatttctctgcagaggagtattatggaaagtcagttgatgctgaggaggtggtagagacctagctaactcatctgcagcggctttgagcaaggcttttagaatcataaggtggctggggtcctgtgtcctacaccacaggccagctagttcatttcaggagactttcttttctatctattattactatcttcttctagactgtagttcactaccagagattatccacttagctgcactcagtttgcacctggcctgtatcaccacttagctctcactccagcctcagttaggtatcagcaagacctcaccaaagattattgtttcattgtatatgtgtgtgtgtttttgtttgtttcaggtaacaactgatgttggaactatgaaaagctcttctctacttttaacaaagcttagtcacaaacagttccccagttgacgagaacaactaaaacaacagaacaattgaaagtccaaatttgaaagctccatctccgagaagcaaattttacagccactccagatttgtattccaaatggatagtttgattataaaaatcacatcccttcagcctgcaaatgtgataactgcccaagagacagtgatgcctacatccatagataatcccctttcccccaacctatatataactggagtcaacagcagctggaggaaaatggcaaggacttgtaatcaagattaagttagaaaaacactgctgtagactgtttatcagctcttcagcatatgtccgttttccttgaaggatgagcgtttagaaacctctgacaataaagtttattttacacacattctcttgcctatcatttttttttgtacaaatcacaattataaaactttcttgctccagctaaaagcaggaaactcagtcacaaatgtgttcactacatgtataccacagaatgatagcaaccagtctgattgcatcacttgattccaaaattaaatgttagcactcagtagtgaaactacatgtatctccaactctggaagccacaggcaagatactcctgtttcctgcagggaaacagatctataagcagggcagcagtctcacacatgtacactcctgtgaaatccaaggaaataatgatagtgacacagggcaggcaagccccaaaactggtttgtagcgtgggaaatttctcccagactgtagtctccttggctttgccaagaaaagaattcaaggataagccgctggtgagagaaagcaacttttattgaactggtgctacttcttgcagagcagggctaacctataggcagtgtgcccagagttggtgcctgtgggctactagctagttgtatttagagccacttttaattgcatgccaattaagaggtaggttattcagaactttctgggaaaggggcagggagtttccagaaccatataaagtaacttccaggccattgccaaggtgtgttgccatgacatttgtaaactggccatggtcccagtggtagtgtctttatgctcataagcagtgagggcaactagaggtcactttcatcatcatctgctggtttcagcaggcttctccactgcaccctgttttgaccagatcctgctctgttcaatggggttgggaatggaaaataagtccttctggtctcctacctcatttccccatcagagattatatactcctccttaatcttaaggggcttgcagaagggcggaggttcatcttctgtaactgcttcctgctgatgttatgggcatagaccctgcctagcactggagaggtaaaatccctggatacctgttctaaaaggctcaaaggtaggatgtctttatcttctgggtcagaagaggggatgggttgaaagccttgtgccagcatcatctttacatggaattattgtaatctggaagacacaaactttacaaggaggttaaacaagcaaagagcaaagattagtaataaaaagatatctattaaaggtcctaggaagggtaaaaaccaagtgtctgctggtagagattcctttactgaattccatcagcagggcaaagcagtaagagggaaaacattataattaggaataagagaaaaactttcatgctcatccacagcatcatgttattattgttatctgtgcatttgcaaaacaatagctttaagtcttccgggcgtttgcaaatataggtcacagcatcgtcctctgacatctgtgaggactcataacaatctttgagggccgggggcggtggctcacgcctgtaatcctaatactttgggagactgaggagggcggatcacgaggtcaggagatcgagaccatcctggctaacatggtgatatcccgtctctactgaaaatacaaaaaaaattagccaggagtggtggcgggcgcctgtagtcccagctactcgggagcctgaggcaggagaatggcgtgaacccgggaggcagagcttgcagtgagttgagatcgcgccactgcactccagcctggggacacagtgagactccatttgaaaaaaaaaaaaaggatctttgagcctgggcatagtggctcatgcctgtaatcccagcactttgggaggctgaggcaggcatttcacaaggtcaggagttcaagaccagcctggccaacatggtgaaacctcgtcgctactaaaaatacaaaaaaaaaaaaaaaaaaaattagtcaagcatggtggcacgtgcctgtaatcccagctactcaggaggctgaggcaggagaattgcttgaacccagaaggtggaggttgcagtgagccgagatcgagccattgcactccagcctgggtgacagagcaagatttcatctaaaaaaaaaaaaaacaaaattaactttgaagtttaacagcagtgggggtgcttaataatgcctgataggggccctttccattttggttgtaattgattcttgggggattcttctttctaagtttttagtaagactaagtatcctggttgaatgggcgagtcaatccttttccttgtgggaggaggttacgtttcacttccatatgattgaagggccttttgaacctggcctaagttgataacctatgtatctcttcaacaaacagaacgtctaaagttaaaaagggccttccgagctgctcaggcgacccagcctcccatcgctgctgctctagtgttcggttggcctgggccacactcaactgtagggagcccaggccaagaggcagcctgggccttctgcattgcgaggcgccgggcctcccgcagcgctccgctgacgggctgcgggcgggcaggcgggaggcctagtgtgggtcgcggtcgtggcccccgccgccggccctggccgccgcatcatgaacatagatgtggagttccacatccggcacaactatacctggaacaagttgccggccaatgtgagacagtcattaagtggagatggctcatcatggaggtcttcatccttgtcttcacaagtaggctgaagaggaggaaatacaggatgtattggtcttgctgttcagggtggtagaggaggaagaaaatcccagtcgtctttgaaattcacagagaatatgaaaagcagg

SEQ ID NO: 12729 - DNA, 478 bp, Homo sapiens
aaaaagcagaaactgctgattgttcctttttttgttgactgattatacaatgtgtccttttaaaaatggttctctgttctctttgcagttcttgtattggttcctagttcctactaatttctcacacttagttaactagtcagtcttactgaaaagtaaactaaccagggatccctggtttctgtatctttcaaacctatagggttacaaaccaaagtgagatgcctatctggtttctgcacagttgtcctgaattatgttggcagatattttatacctagaaattcaccttgaaaaataaattgaaaccataccaagtatttagagctaggggtctaaagtctgcaaaagccctgggaggttgcgttgtctcaagagccagtattcaatggaccactccacatcatagtaaataaaatttgaacacagcattttgaagccaatagtatgggtctctgtgtgtcctgtgtgccctgag

SEQ ID NO: 12730 - DNA, 835 bp, Homo sapiens
gagaaacacaatactgtttctgcatcataacaaagatctagttgtgcaaactgcacagccagaccaacccaattatggttttcctctggatctcttatactgtgaaagccttcttggtctggaccctggaactttcagcagagttttaaacaaaaactacacgctgcttgtttccatggctcccctcaccaatgaaatccggcccatcagcagctgcacccctcagcatattggaccagctatcccagaaatcagctctgtctggtttaaacggtacatttatcatatcactggacaaggaccaccatcccttttattgtccaaaggtacaagacctcaaaaactgccagatatatttcagagttatgatcgattgctaataacatcttggggtcatgatcctggagtagttcctacctcaaatgtgctcacgatgttgaatgatgctttaacacattctgcagttttaattcaggagcatggtctgcatgggataggagaaactgtccatgtcccatttccatttgatgaaacagaactacaaggagagttcactcgtgtcaatatgggtgttcataaagcattgcagatactaaggaacagtggacttacaacatctctgcggatatgtcaccatgttgaatgtttccatccaacttgcaaatagaaaactcagtgatgcttctgatgagagaggaaaacctgatttggcttctggctcagatgtaaatgggagtacagagtcatttgaaatggtcattgaggaagcaactacagattcagcaacaaagcaaacctctggtgccacaacagaagcagattgggttcctctcga

SEQ ID NO: 12731 - DNA, 6222 bp, Homo sapiens
gcctgaggagacccgttgggtcctcagcgtcttggcggcagttggtggaaccggagcttcgagtccgtccccggtgctgcctgcgcgttcacctgagtctcgctggagctcttctcgcccgcccacctcatctcaacccactttccgcggggagcggcgccaagctgggccttcctcggatcaggcgtcccctgaagtcggcacgcccctctgcgtcccccttcggtcccgctaggaccccgtccgggctgccgtcgcctcgtcgctatggcgcccaccatccagacccaggcccagcgggaggatggccacaggtaggcgccacgcttttctgttgcagcaaggcgggggatcgggagagggtttctgctgaacaacgtcaccagcccccaggtctgcccgtgacgtcatgaagcgctcacctttgacgaagggggcgggttccttctgagattcaggtgttcccctcctccccgccgtgcagttcagggattaggcttttggagactccctccagaagggatccctccagtcaaccgtttggagacccctcttccgaagacgattgagtacatggttctttattaaagcacttgaagccatctcctgcaaaagggattgagcacttggccttgttcattaaagcttttgggggcatttcttcctaaataaattgaacatttgtctccttccattaaagcatttggacactccccacaccaccacccaaagaaaccagcatttgtcacccctccttctaccttttgaaaggttggggaagcctttttcattctcctgtcaatcccgtcctctccacctatcactgtttctttcttctccactaggcccaattcccaccggactctgcctgagaggtgagccccactgtgctttcccaggagcggtggggcagtggggctgggagcagaggtggggcagcgggggcccacttttgagccactaatgttcctaggtctggagtggtctgccgagtcaagtactgcaatagcctccctgatatccccttcgaccccaagttcatcacctaccccttcgaccagaacaggtgagactaaggaatgggaaaactactcaggtatgagttccttgaaggcagggactgcttgtctcgttggctgctgtctgctcagggcctagcacagtacctaccctagcacatagtagtagctgctcaattgttaatggagcaagcagtgtccaagtcccttcccactggggagccagctttcagactctgccatgggggacacttcattctgagttcctccccagagaagctccgcctctgggaagcagggctgtgaggggtgaagctggaatccaaacaccacaataggtgtttccccacccaggttcgtccagtacaaagccacttccttggagaaacagcacaaacatgacctcctgactgagccagacctgggggtcaccatcgatctcatcaatcctgacacctaccgcatcgaccccaatggtgtgtggggagacagggagggtctgctctaggtcagcaaaggctcaggcctgggcctccctcatggtcctcctgccccccgctctcctctagttcttctagatccagctgatgagaaacttttggaagaggagattcaggcccccaccagctccaagaggtgagtgggtagcaaatgggtactggagactggctcaggtgggccctacaagcaggagggcagtggggtcctgagatacctgatttcccaccccagatcccagcagcacgcgaaggtggtgccatggatgcgaaagacagagtacatctccactgagttcaaccgttatggcatctccaatgagaagcctgaggtcaagtaagttactaacaggaagagagggaaggtggagatattaggtgtgtccagtggcccctaaggacctttttcttcattcctaggattggggtttctgtgaagcagcagtttaccgaggaagaaatatacaaagacagggatagccagatcacagccattgagaagacttttgaggatgcccagaaatcagtaattgagggactgggatggggagaggcaagggtgcggctgcagagctcctcctcaccttgtttttgtcccaccagatctcacagcattacagcaaaccccgagtcacaccggtggaggtcatgcctgtcttcccagactttaaggtcaggcccaaggtgggaggtagaaagggacagcctatttgtgcctgttcccatctaaccccagtgcctccatctccctagatgtggatcaatccatgtgctcaggtgatctttgactcagacccagcccccaaggacacgagtggtgcagctgcgttggagatgatgtctcaggccatgattaggtaggtggtcctgctgtccaccttggcctgctccttgctgcctcttgtcctcacacttcattgctactccttttcccccaaccaggggcatgatggatgaggaagggaaccagtttgtggcctatttcctgcctgtagaagagacgttgaagaaacgaaagcgggaccaggaggaggagatggactatgcaccagatgatgtgtgcgtgggttgcggttaagttttggggattgggaagttttggggattgggatagggaagaaatggggctgaacctgtgccctcatcttcaggtatgactacaaaattgctcgggagtacaactggaacgtgaagaacaaagctagcaagggctatgaggaaaactaatacttcatcttccgagagggtgacggggtttactacaatgagttggaaaccaggtactcagcacactcctatctgattagcctggatctgtgcttcttaagaccctggggcatgcaagagccaccttggaggtcatttgtacctaagaatttgtcatatgcattggtaaacaagagcagcagatgtctggtcatgcacatgagctggacttggttctaacaggaggagccagaaaaaaaatctttttttttgagatggagtctcgctctgttgcccaggccagagtgcagtggtgtgatctcagcccactgcaacctccgcttcctgggttcaagtgattctcctgcctcagcctcctgagtagctggcatcacaggcgtgtgccagcatggccagctaattttttttgtatttttaatagagatggggtttcaccatgctggccaggctggtcttgaactcctgacctcaggtgatctgcctgcctcggcctcccaaagtgctgggattacaggtgtgagccaccacgcccagccagaatatcttaatgcaggagacatttagagcctttgcgcaaggcagagggccaagtttcccagtattagtaacagacttcatgtgaaagtaaacattgccaaagtatggagtaatatataaaattagcatgaatgttttaaatgaaatgcttaaacccatgttcaaaaatgtgactccaaaactcttcccttatggctcaaagtttactgctatgccagcacctctggtgtagagttgggaagtcttgagtttctgtttaaagcagagattacaagaactgtgaccccataggccaggcaggaaatgtaaaagagcagtggctggtagcatctgagtgacctggagttctgggcaaccatggagggcactattcacttccagcccactgttgctgtgctgtggggccagaaattcctatcttccaaaagccccaaatccaaatgatttgacatctcctggtttctcaaagtgttggtaactaactgacatatacagtaatgcactgcatgtttcagtcaacaatggactgcttatggtggtcccttaagatagaataccgtatctttactataccttttctatgtttagatacacaaatacttactattgtattacaattgcctgcagtattcagtacagtcacatgctgtacaaccttgtagcctaggagcaataggctacaccattacagcctaggtatgtagtaggctatactatgtacgtttgtgtaagagtactgtatgatgttcacatgatgtatatctcagaatgtgtccctgttaaatggcccatgcccgtatttatgtaaatacaccgtataacacacacacacagtgtagggcaaccaaactggtgccatgggagccatccttcctttcccctgccctcaataccttgagcttagctgcccttattcaatctgtatttattcccatttactctaagtattgatggggaaccaagtcagaccagacccctcactggggggcggggaagtgggaggtgtgtctttaactgcatcttccacttctctctcccaaattcaccccctgcagggtccgccttagtaagcgccgggccaaggctggggttcagtcaggcaccaacgccctgcttgtggtcaaacatcgggacatgaatgagaaggaactggaagctcaggtaacaagcaccactggctcagggcacccatggcagggagggtggtggttgtaggtgaggagggggacaaaaacccagcagaacaccctccttcccctcattccaatcttgctgcttccaggaggcacggaaggcccagctagaaaaccacgaaccggaggaggaagaggaagaggagatggagacagaagagaaagaagctgggggctcaggtaaatctggacaggccagactctgggagccctgggagggtggaaaagtgggtttcatctctctccactcccttccagatgaggagcaggagaagggcagcagcagtgagaaggagggcagtgaagatgagcactcgggcagcgagagtgaacgggaggaaggtgacagggacgaggccagtgacaagagtggcagtggtgaggacgagagcagcgaggatgaggcccgggctgcccgtgacaaagaggagatctttggcagtgatgctgattctgaggacgatgccgactctgatgatgaggacagaggacaggcccaaggtggcagtgacaatgattcagacagcggcagcaatgggggtggccagcggagccggagccacagccgcagcgccagtcccttccccagtggcagcgagcactcggcccaggaggatggcagtgaagctgcagcttctgattccagtgaagctgatagtgacagtgactgagtcccagggcattcagggctggttcagacaccattattgtgagcagcaaagcacttttctagtggtctgtttgtgagcctttcacttgtttgttccccacccccaaacctttgctgttaataaagtcaacttctctttacttcccctcccagcccctatgatgtcattcagcccagcacatacctcccgcaacccccaggtgctcaaggatcttggcttgaggcttagaaacacaggccagaggcagggccaatggtttcccacaaaatgtagcacaacgaaggtcagaattcgttttttttgtttggtttttttttttccaaaataagcccagaccattaaacaagtgaaactccaacaaataagtcttctccaacagcgagaaaaactgtacagttactcaaagctgattctgccagtggggccggggacagaagtgggtagggagggtgaaatcatggaggagggcctggggagggggctggagcgggagagggtcagggtcctgcccatcagagtggggccgcctgcgtcctgcacactctgctgtcaggtggggtggggggcagctcttgcctccctgtgtgtgtgagacggtgtccctcaccacctcccagtgccaggcacagtcagctcaccctgatggagagtgaacaagacaggacaggctggggagaggggagggtcccatgagagggacaccctgctgattccaaacgaggtggcccatccatcccacttcctgcagctagtgggagggggactggagaagccctgggagattgaggggatgagcaaaggcacagaaacatggagggccggggtgggggacttgcataggttgatgagtgtgcaagaggtacataaataaacctgacaccccacccagcccggcactgggagaggaagtggggacccagagccaggttcccagggccaccctaccccctggcttcttccccctccctgggctcagagcagagggaagtccacagaccaggagggcgggggcaagaaggtctggggaatggggtgatagtgcagggagggtggtggttttaaaatttttttttttttt

SEQ ID NO: 12732 - DNA, 199 bp, Homo sapiens
cgggatgagcatcttataacgctgcacaggatcgaagtcctgttgctgttgctgcaggaggccgctctgggcagggcccaccagttgtgctggcggttgcggctgctgctggggacccgggccgccagccgaactaggacccgatacaccagcagctgaggaagccgctgaagcttgctgctgggatgcagccatcttc

SEQ ID NO: 12733 - DNA, 2440 bp, Homo sapiens
gcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccagacaa

SEQ ID NO: 12734 - DNA, 149 bp, Homo sapiens
aaacaaaaaaaaaaaaaaaaaaaaaaaaaaaaaaaaaaaaaagaaaaaaaaaaaaaaaaaaaaaaaagaaaaaaaaaaaaaaaaaaaaaaaaaaaaaaaaaaaaaaaaaaaaaaaaaaaaaaaaaacaaaaaaaaaaaaaaaaaaaaaa

SEQ ID NO: 12735 - DNA, 152 bp, Homo sapiens; identical to SEQ ID NO: 11426

SEQ ID NO: 12736 - DNA, 96 bp, Homo sapiens; identical to SEQ ID NO: 11518

SEQ ID NO: 12737 - DNA, 130 bp, Homo sapiens; identical to SEQ ID NO: 11519

SEQ ID NO: 12738 - DNA, 143 bp, Homo sapiens; identical to SEQ ID NO: 11520

SEQ ID NO: 12739 - DNA, 151 bp, Homo sapiens; identical to SEQ ID NO: 11427

SEQ ID NO: 12740 - DNA, 202 bp, Homo sapiens; identical to SEQ ID NO: 11428

SEQ ID NO: 12741 - DNA, 125 bp, Homo sapiens
  misc_feature (33)..(33): n equals a,t,g, or c
  misc_feature (49)..(49): n equals a,t,g, or c
  misc_feature (61)..(61): n equals a,t,g, or c
  misc_feature (90)..(91): n equals a,t,g, or c
  misc_feature (116)..(117): n equals a,t,g, or c
gttgtggaaaaaaaaaaaaaaaaaaaaaaaaanaaaaaaaaaaaaaaanaaaaaaaaaaanaaaaaaaaaaaaaaaaaaaaaaaaaaaannaaaaaaaaaaaaaaaaaaaaaaaannaaaaaaaa

SEQ ID NO: 12742 - DNA, 3985 bp, Homo sapiens
gaaaagaagcgaaggaagtcaaatactcaggtgaatggtggttggtggtgggtttggttcccagcagccccttggcggcacactgtctactctgccattccagtatctgtttgtatcttgtatcagctgcagggaggagagagaaaactgtctttcttgctttgcttcttgttctttcgctgaaccttataacaagtttaggggaaagtatcctctcctaagagatgattcgaccaaagttcttaccacgcagggttccagtctcctccatgtttcctgtcctggtttcctcctgatgataacgtaacacctaccacttactgatcctttttttagtgccagggattgcgctaacatgctttaacagtttggggagataggcattatccctattttacagatgagaaatctgggggttaaaaatgttaaatacatgctccacagtcttgaggttgtttttcagggtcagagctgggattccatcctagttctgcctgtttttaaaacatagttactgcactatgttggttccactctccaccctctttttcttgtctttttttttttcttttttcttttcttttcttttctttttttttttttgtagtaacagagacttgctgtgttactactcaaactcatgggctcaagggatcctcctgcctcggcttcccaaaatgttagcattacaggtgtgacccactgtgcctggcctgtggtccatttttttttttttttttttgagacggagtcttgctctgttgcccaggctggagtgcagtggtatggtcttggctcactgcaagctccgcctcctgggttcacgccattctcctgcttcagcctcccgagtagctgggactacaggcgcccaccaccacgcccggctaatttttttgtatttttagtagagacggggtttcaccgtgttagccaggatgatctcgatctcctgacctcgtgatctgcccgccttggcctcccaaagtgctgggattacaggcgtgagccaccgcacctggcctgtggtccatattgattttagacctgagctgcccacagtatcagcctccaaaatgtgtattgtgttggtagtgctctcttggtttagctctgtgtttccctccatgaccctctttccctcaactgtttctcactagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggcccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccagacaa

SEQ ID NO: 12743 - DNA, 151 bp, Homo sapiens
  misc_feature (4)..(4): n equals a,t,g, or c
  misc_feature (45)..(45): n equals a,t,g, or c
  misc_feature (89)..(89): n equals a,t,g, or c
aaanaaaaaaaaaaaaaaaaaaaaaaaaaaaaaaaaaggaaaaanaaagaaaaaaaaaaaaaaaaaaaaaagaaaaaaaaaaaaaaaanaaaaaaaaaaaagaaaaaaaaaaaaaaaaaaaaaaaaagaaaaagggaaaaaaaaaaaaaaa

SEQ ID NO: 12744 - DNA, 4901 bp, Homo sapiens
  misc_feature (3897)..(3897): n equals a,t,g, or c
gattttcttctcgggctgcaaacaaagggaagcctgcaacaagttaagctgaagaccgaagcaagagctggttcaggtaatgccttagctgggaaggggtccacagattcgctttgaagggggtggaataaggaaaagggaaggcggaactaatctagaaggaatgagctgcttttcatttctgggctgggggaggaaggccaggtgccgacgctaacacaacaggaacttgctctgggtaccccaggcaagtggccctagatcctttgctttagcggtttggaggagcaactgttagaggagtttaaattaactagaggcgagacttcctagctttatgctgagtgggagagctccccctttagctgttttttagaaatagcagaagtctctgtcataatccttacaggaggtgtttgttgaatcctgcctgaatgaaaagaagggggtggagggagggagtggaggtgggttttcttccagaaggtcgatgaaaagaaaaagatctggaaacacagcagggaagggtggagattagacagcagaaggaacttcctaataaggcagtgagatgctggcttgggagagagaggtgtttttttgaccctggggttaacctaacccaagaaagaggtatcagggtttggaaaccccagagtataggagtttcagagtgtctcctatttgggtctcataagtatttgttttgttgacccaaatacctttgctggtttccatggagacagtgggtctgacatcactgtggttgccatggtgcctggttctagaggacctgagcaggctgcacacacagctagggataaacagggacttcagcccaagctgctgccacttccttcctgccaccacctgttaacagtcagcaactggggatggggagatgataacaagggcgggggtggagccacaagcggaaggctgaacagccatggctctatggatacttacagatgcatgccagggtgtcctgttggatttggtacagggaggtcattgcagccattctcctgtctccgtgtggaatgggtgcatgtgtctgggaggatgggcattgggaaagacctatccaggacttggatcttgactggcaggagccacaggaggttacttagggcaccacgcaggacttgaaaacagctcaaacagaaggggataatgtggttggtttcaaaggtagaactgccatactctcccagcctcacttcccttttcctgagttttcttataaagtgctcgggaagcagtcatttatcctgttctgagggatcacaatccagtactcttgagaggtcagctcatctatccttccacctttatgcctggtcccaacaggagctgcctgagggaactgttttagccttggatgaaggggcggatccctctcttcttaccctgctttgtgtcagtcaggctttggaaactggaaaaatccctcccctatccctgtcaagtcagagcagattaaccgggtgcaggaccatagccctgatttttgtctattttttgcaagctataaagtgatgtatatatacatgatagttgccataaatccattttcccagtcaccttcaagttccctaagaccaaactctggcgattactaagaaggtaaacagaatttaggatgaagactgagagtgatgaggagacttataaaaggtgcatccaggtggatttaagctatgccagtggctcttaaccctggctgcgcatgagaatcatttgagtggttttttaaaagacccacagccgggcctaccccccaactcaattgaatcaaaatcttaggtgattccaatgtgcagccaagattgagaaccactgaactagaccataccaaggacttatgctgggcaagtggtgggacacttagggctgaaggaggccattgagtcttcccttccaggtcctgggggagaaggtagtgattgtgtaggtacctggtgttgtgaagggagggctgtgttgtttccctgctcttcttattaacaagtcttcttattggcaagttgagtctgtcaaccttgctgggcttcatcttccctgactcaaatgtcagggggctggactggaattccccagagcctttccagcctatgctactttgacctttcaaggtcagttcagttttccaaggccctgttggtccctggaagaggctggcttctctgtgggtgttggcagattctgatttgcaaggcaaatactgcttagaagagctggggtgtcagggagagaaggactggaaccaggcttggttctggaggctgctgcccagcacttgaaccttggaacccagccaaggctgctttctgcattctgcccctcctgaagggagctcccatccttaagagagctttcttctgcaggtggcagccacagcagcctcagggacctcagcaactatggcctcctgcccagactctgataatagctgggtgcttgctggctccgaggtaggaagagcgggcctgggaaccatgggggtggggttggggggtgtttctgcagtgctgggcttctttcttggtgggtccttttccttagtcctgatggtcacctacatcacttcctgctggctgttagaggaattccagtagcaggaagaagtagatcaggccccaggggtcaggtgttggcacttggaccatgccatgaaggaagggaccagttgggtaagctgagacaagtagggatggatttcgaatggagagaccaatgtgaacaaaggtcctgaggcgatagtggggaacgccatgctgggggagactgtgggacacccatgggtgatgtggagacgtgggttggagccagtgttggagtgaggttggggacagagcctgggaacccctggaagagaccggaagagcctggctgaggccttcaggcctcatccctgatgggaaatcagtgtggggctttgggttagagggatcaggacaatcattgtctcaggcagagggtgaagccactgtgcatgctgggtgggaacagggagagagtgtttcaaagaccccctgcagcagtccaggtagcagctggtggggcagaagcccactgaggagggagaagggggttggcaggatggggaactgagtggctagagaagggatggcaaaaatttgtcaaaggcatctctgagagttccaagacgtagcgactttgtatattagagccaccaggaggggaggaggagagaagctcagtttcaacatgttgagtttgaggtgcccttgaggaacccagctgggagtaaggagttgaccttggggatgacgctggagcaagataatggactggggctcactggcagagggaaggcaggtatgagcagacgggcaccaggctctcagagccctggcctcctgttgaggtgtctttgttgacagctgggggaccttgggcatgccatttcacctctctgtcctctcctgtaaaacgggcgtcatgatttttgccttgtaggggggaccatgagaataaaaatgttttgaaaatagcaaagacataactaaggtgaagcattactctcagagggatagttggagccacggggcgggtggcaggccagggccctatggaaggggagtaggcagagggaggaggccgaggctgtgtggccagggctggatgtccaggctgagagtgccctggagacaggctgtctgtggttggggtgggatgggcttctgtgagcagctgctgggagacgggtgtcgggggagtgtcaggggccagcgggaaaggccagaaaggcttgagagatgtaagtagttgtccagttgagagggcagctgcagggacaccctgggaggcataactgtgacccgtgggcacccaggggactttgttctcttgccttcttcccacccttantattataatatcgcgggctgttcatctgcggggaaggaagtgctgcttgtcttgctgggagggaatcgtccgctctagctcaccttctggaggcggggcaccaggtttggactcaaaccagtccctggtctgtggtgcggcgctgggaaccggaaacctggcccctgaaagttcctcctcccagtgagttaggctgggaaatcccgagcacttggtgctgccccgagcccccttttgggccagctcatgactgaatgtgtgtgtttctgggatgtgggctggggccccattcttgggtgcagcccttctccttgcacttctcctcccagagcctgccagtggagacactgggcccggcatccaggatggacccagaatctgagagagccctgcaggcccctcacagcccctccaagacagatgggaaagaattagctgggaccatggatggagaaggtactgggccctgcttaggacatagcttaccggacaaagctattctccatattttggggtttctcagtttcctcagagaaagggaggctggttcgttttagttcctccattaatctcagttgacaaactccttttctcattccatcctggctttttcctgcctcttccaacctggtaggggcccgtgggatggacagagggctgcaaaggaaattcagctggggcagtgggtttttctgcgccttttctcctaccgcagggacgctcttccagactgaaagccctcagtctggcagcattctaacagaggagactgaggtcaaggtgaggagatttgctgtgggaaggaagggaggcggggagggctagcagctgctcactgctgcatctgcattagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagtctgcctt

SEQ ID NO: 12745 - DNA, 293 bp, Homo sapiens
tttttttttttttttttttgagacggagtcttgctctgttgcccaggctggagtgcagtggtatggtcttggctcactgcaagctccgcctcctgggttcacgccattctcttgtttcagcctcccgagtagctgggactacaggcgcccaccaccacgcccggctaatttttttgtatttttagtagagacggggtttcaccgtgttagccaggatgatctcgatctcctgacctcgtgatctgcccgccttggcctcccaaagtgctgggattacaggcgtgagccaccgc

SEQ ID NO: 12746 - DNA, 77 bp, Homo sapiens
aaaaaaaaaaaaaaaaaaaaaaaaaaaaaaaaaaaaaaaaaaaaaaaaaaaaaaaaaaaaaaaaaaaaaaaaaaaaa

SEQ ID NO: 12747 - DNA, 118 bp, Homo sapiens; identical to SEQ ID NO: 11525

SEQ ID NO: 12748 - DNA, 77 bp, Homo sapiens; identical to SEQ ID NO: 11431

SEQ ID NO: 12749 - DNA, 15980 bp, Homo sapiens
  misc_feature (13404)..(13404): n equals a,t,g, or c
gattttcttctcgggctgcaaacaaagggaagcctgcaacaagttaagctgaagaccgaagcaagagctggttcaggtaatgccttagctgggaaggggtccacagattcgctttgaagggggtggaataaggaaaagggaaggcggaactaatctagaaggaatgagctgcttttcatttctgggctgggggaggaaggccaggtgccgacgctaacacaacaggaacttgctctgggtaccccaggcaagtggccctagatcctttgctttagcggtttggaggagcaactgttagaggagtttaaattaactagaggcgagacttcctagctttatgctgagtgggagagctccccctttagctgttttttagaaatagcagaagtctctgtcataatccttacaggaggtgtttgttgaatcctgcctgaatgaaaagaagggggtggagggagggagtggaggtgggttttcttccagaaggtcgatgaaaagaaaaagatctggaaacacagcagggaagggtggagattagacagcagaaggaacttcctaataaggcagtgagatgctggcttgggagaagaggtgtttttttgaaccctgggttaacctaaccaagaaagaggtatcagggtttggaacccagagtataggagtttcagagtgtctcctatttgggtctcataagtatttgttttgttgacccaaatacctttgctggtttccatggagacagtgggtctgacatcactgtggttgccatggtgcctggttctagaggacctgagcaggctgcacacacagctagggataaacagggacttcagcccaagctgctgccacttccttcctgccaccacctgttaacagtcagcaactggggatggggagatgataacaagggcgggggtggagccacaagcggaaggctgaacagccatggctctatggatacttacagatgcatgccagggtgtcctgttggatttggtacagggaggtcattgcagccattctcctgtctccgtgtggaatgggtgcatgtgtctgggaggatgggcattgggaaagacctatccaggacttggatcttgactggcaggagccacaggaggttacttagggcaccacgcaggacttgaaaacagctcaaacagaaggggataatgtggttggtttcaaaggtagaactgccatactctcccagcctcacttcccttttcctgagttttcttataaagtgctcgggaagcagtcatttatcctgttctgagggatcacaatccagtactcttgagaggtcagctcatctatccttccacctttatgcctggtcccaacaggagctgcctgagggaactgttttagccttggatgaaggggcggatccctctcttcttaccctgctttgtgtcagtcaggctttggaaactggagtgattccctcccctatccctgtcaagtcagagcagattaaccgggtgcaggaccatagccctgatttttgtctattttttgcaagctataaagtgatgtatatatacatgatagttgccataaatccattttcccagtcaccttcaagttccctaagaccaaactctggcgattactaagaaggtaaacagaatttaggatgaagactgagagtgatgaggagacttataaaaggtgcatccaggtggatctaagctatgccagtggctcttaaccctggctgcgcatgagaatcatttgagtggttttttaaaagacccacagccgggcctaccccccaactcaattgaatcaaaatcttaggtgattccaatgtgcagccaagattgagaaccactgaactagaccataccaaggacttatgctgggcaagtggtgggacacttagggctgaaggaggccattgagtcttcccttccaggtcctgggggagaaggtagtgattgtgtaggtacctggtgttgtgaagggagggctgtgttgtttccctgctcttcttattaacaagtcttcttattggcaagttgagtctgtcaaccttgctgggcttcatcttccctgactcaaatgtcagggggctggactggaattccccagagcctttccagcctatgctactttgacctttcaaggtcagttcagttttccaaggccctgttggtccctggaagaggctggcttctctgtgggtgttggcagattctgatttgcaaggcaaatactgcttagaagagctggggtgtcagggagagaaggactggaaccaggcttggttctggaggctgctgcccagcacttgaaccttggaacccagccaaggctgctttctgcattctgcccctcctgaagggagctcccatccttaagagagctttcttctgcaggtggcagccacagcagcctcagggacctcagcaactatggcctcctgcccagactctgataatagctgggtgcttgctggctccgaggtaggaagagcgggcctgggaaccatgggggtggggttggggggtgtttctgcagtgctgggcttctttcttggtgggtccttttccttagtcctgatggtcacctacatcacttcctgctggctgttagaggaattccagtagcaggaagaagtagatcaggccccaggggtcaggtgttggcacttggaccatgccatgaaggaagggaccagttgggtaagctgagacaagtagggatggatttcgaatggagagaccaatgtgaacaaaggtcctgaggcgatagtggggaacgccatgctgggggagactgtgggacacccatgggtgatgtggagacgtgggttggagccagtgttggagtgaggttggggacagagcctgggaacccctggaagagaccggaagagcctggctgaggccttcaggcctcatcctgatgggaaatcagtgtggggctttgggttagagggatcaggacaatcattgtctcaggcagagggtgaagccactgtgcatgctgggtgggaacagggagagagtgtttcaaagaccccctgcagcagtccaggtagcagctggtggggcagaagcccactgaggagggagaagggggttggcaggatggggaactgagtggctagagaagggatggcaaaaatttgtcaaaggcatctctgagagttccaagacgtagcgactttgtatattagagccaccaggaggggaggaggagagaagctcagtttcaacatgttgagtttgaggtgcccttgaggaacccagctgggagtaaggagttgaccttggggatgacgctggagcaagataatggactggggctcactggcagagggaaggcaggtatgagcagacgggcaccaggctctcagagccctggcctcctgttgaggtgtctttgttgacagctgggggaccttgggcatgccatttcacctctctgtcctctcctgtaaaacgggcgtcatgatttttgccttgtaggggggaccatgagaataaaaatgttttgaaaatagcaaagacataactaaggtgaagcattactctcagagggatagttggagccacggggcgggtggcaggccagggccctatggaaggggagtaggcagagggaggagcacgaggctgtgtggccagggctggatgtccaggctgagagtgccctggagacaggctgtctgtggttggggtgggttgggcttctgtgagcagctgctgggagacgggtgtcgggggagtgtcaggggccagcgggaaaggccagaaaggcttgagagatgtaagtagttgtccagttgagagggcagctgcagggacaccctgggaggcataactgtgacccgtgggcacccaggggactttgttctcttgccttcttcccacccttaatattataatatctgggttgttcatctgtggggaaggaagtgctgctgatcttgatgggagggaaacgtaggctctagctcaccttctggaggcggggcaccaggtttgtactgcaaccagtgccttggtctggtggtgcggcgctgtgtagcggaaacctggcccctgaaagttcctcctcgcagtgagtgaggctggggaatgccgagcacttggtgctgccccgagcccctttttgggccagctcatgactgaatgtgtgtgtttctgggatgtgggctggggccccattcttgggtgcagcccttctccttgcacttctcctcccagagcctgccagtggagacactgggcccggcatccaggatggacccagaatctgagagagccctgcaggcccctcacagcccctccaagacagatgggaaagaattagctgggaccatggatggagaaggtactgggccctgcttaggacatagcttaccggacaaagctattctccatattttggggtttctcagtttcctcagagaaagggaggctggttcgttttagttcctccattaatctcagttgacaaactccttttctcattccatcctggctttttcctgcctcttccaacctggtaggggcccgtgggatggacagagggctgcaaaggaaattcagctggggcagtgggtttttctgcgccttttctcctaccgcagggacgctcttccagactgaaagccctcagtctggcagcattctaacagaggagactgaggtcaaggtgaggagatttgctgtgggaaggaagggaggcggggagggctagcagctgctcactgctgcatctgcattagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcaggtgagagtcttccttgcctctcctgtcactctccttctagaaggtatgggagagggatcagccatcactactgagcacatgctgtggtccaggccctagggctgagcagcttggtgctctcctttctcaccactacccctgggacgttgaggcccagaaaggttgaatgacttgaccaaggtcacactgctggtaaggggcagggcccacatctggttgactctttcctctctgccatggggacctcctcttttcttgcttccagaattcaaccctcatttctggagtcccttccttgtgctggccctgggcctgggcagagggaagatggttggttaccgcctatgtaagcggcagatcagactgagccaaggtgcatatcagacctaagagtggtacagaactgtaattaaggtactcccaaaggaaggagaggccattcagtcaggggactggttgagggcaagggagaggctgggacagtgagaggtgacatttgagtggagccctgagcacagagtaggcttttggtacgtagggcagggaaaagagaatgttttaggccaaggctgcagcatcagcaaaggagtggggaccacctgtcttgtgctaaggagctctgttccaggcttgtggcagaggagtgtaggaattggtccctgttgagtgacaggatggagggcctgggggccatttaggaggcaactgcagtggtcaggcaaagatgatgcagacctgggccaggcatggtggctcgtgcctataatcccagcactttgggaggctgaggtaggaggattgcttgagcccaggaattcaagactgcagtgagccatggtcatcccacttcactctagcctgggcaacagagggagaccctgtctctaaaggaaataaaaataggcggcagggtgcagtggctcacgcctgtagtcccagcactttgagaggccaaggtgggtggatcacctgaggtcagaagtttgagaccagcctgggcaacatggtgaaaccccgtctctattaaaaatacaaaaattagctcggtgtggtggtgcacgcctgtagtcccagctacttcccagctacctgggaagctgaggcaggagaatcgcttgaacctgggaggcggaggttgcagtgagccaagattgtgccactgcactccagcctgggttacagaggtagactctgcctcaaaaaataaaaataaataaaataaaataaaataaaataaaataaataaaaataaaaataggctgggtgtggtggctcacacctgtaatcctcacactttgggaggcacaggcaggaggggctgggctagggtaacccacctaggccaggcgtctgtcctagcatcctcccccaaaaggaatgtttcctatttacccacacatcctgaccctcccctctcccactatagtcagggcgtcttcccagttcttggttcacatcccttgtgctaaggtttgggccagggctggcatacctgttccacatggtacatgaaacatacatggtatcacctgtgattgattggtgtggtctgcctggagcactgtgtggaaaaggatttaaagaacatgccaggtgccatgatcagttaacactgttccaggtatgggaggtggaaacaagactgtgagagccacacattggctatccttaggtgaatctaggaagtgtgtgcttatataaagatgtagatgccgaggctcaggatggaatttggggatccctgtgtctcattcatgatggagatggggtggaggatgaaaaccaaatcctctgggtgttccaggcaggtggatcacttgagctcaggagtttgagaccagcctgggaaacatggcaaaaccccgtctttacaaaaaaatacacacacacacacacaaattagccgggtgtaatgatgcatgcctatagtctcagctactcaggaggctgaggtgggaggatcgcttgagcctgggaggtggaggttacagtgagttgtgatcgtgccactgcactccagcctggacgacagagccagaccctgtctcaaaaaataaaaataaataaaaataaataaatattaaaaaaaaaagaaagaagatgcagacctgaactaaggcaggtacagtgtgggttgtgaacaggggtggactgtcaagatgtttaagtgtagaactgtgaaactgtctggatgtgaggtggagagggagggcttaggttagctagatggtggaagcagtgccttcccctgaattggggaaacaccagaaaagaaccagtttgcagagcagtgtgttgaatgtttggtcccagagggagtggccagcaggcagtcagacatacaggcttggagctctgggaggccaagtgaggagttacacactaaggactcattgctgaaggggggtgtcagtggtgtgggtcagagaattgtgactatgtgtacagtgagaagagcagagaacctgaaatggtgccagggagaccactgactttaggatcagggaagagccagggagggagaatgggaaggagtggccagagagtttggaggcaacccaggagggtggtaatagctgcagaagtttgatgcacagcgcacactgaggaaggaggatgctttcaggatgaaaatggcttttatagctcgtagattgacagcactggtctcctgcctccagactgggcagggacagtcatcaatgcccaggcagaagtgggcaagtgggcaaggtcttcatgtgcccctctctggggtcagggctgacgacctccctccctgtgccttcctctgattcccctctctccctgtgtctccccatctctccagtcacctcactgccctgtccctgtcctttcccctagcttggatcagggaggagggccgctgctccagcagtgacgatgacaccgacgtggacatggagggtctgcggagacggcggggcgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtgagtggtacctctgaggctggggctttgggcttccatgcctgcctgccttcctgccatgttctcaccttacctcacatcacccctccccgaggcctcatcagactcctctgtctctgtccttaggtggcctctcagagtctgagactggtgagtagggaggagcctgtcttgtgctggggagttgtatgtgttctctggttctgtgggtcaggagtaggggtgctgggggctcacatttatttctcagttagtggccttgtcagctgttcagggtgccccttggccctttatctcaccaaaccgctcagccacagggtgggtcctgagcaggagtggtggctgtgtgaatgggaaggtgtggggagaatgggctctgtgtgcctcaggaccagtttcagggtttccctttcccacagggcccatggaggaagtggagcggcaggtcctcccagaccccgaggtgctggaagctgtgggggacaggcaggtatgtgtgaatgtctccagaggcaggtggggcctggctggggagaacctgggctgtggggtagcatggcataacaggctcttctgccctcaggatgggctaagggaacagctgcaggccccagtgcctcctgacagtgtccccagcctgcaaaacatgggtcttctgctggacaagctggccaaggagaaccaggacatccggctgctgcaggcccagctgcaggtgggcacaggcaggaggggctgggctagggtaacccacctaggccaggcgtctgtcctagcatcctcccccaaaaggaatgtttcctatttacccacacatcctgaccctcccctctcccactatagtcagggcgtcttcccagttcttggttcacatcccttgtgctaaggtttgggccagggctggcatacctgttccacatggtacatgaaacatacatggtatcacctgtgattgattggtgtggtctgcctggagcactgtgtggaaaaggatttaaagaacatgccaggtgccatgatcagttaacactgttccaggaaataagactgtgagagccacacattggctatccttaggtgaatctaggaagtgtgtgcttatataaagatgtagatgccgaggctcaggatggaatttggggatccctgtgtctcattcatgatggagatggggtggaggatgaaaaccaaatcctctgggtgttccaggctgtaaaacgggctcaggccacctgcccactataatagaatggaattggggtagaaggcattggggctatcctgacaagaactctttgtgacttcctttgtcccaaaccatattctaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtgggggtagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtgggcagctgtgggggagttgggtcgggtgggacagaggcagtcgggaggatgtgaagagcaaggatcattagtttgagtatccttacttttggtccccagctggcttcccttagagaaggcattcaggtccgcttcctttcttcccttgagggtaggaagctgcctgtgcccaccccagagtggtcctgagcagtccccttttgggcagggggattctttctcctgagttgccctgccctacctctacctgcatggcccaggggacgagggagatccccatcttcctgtctccccgactggagcctttatcctgggagaccaggtttttcccacatatgcttggtggtgcctgctcaagtcagcttcattgggaggagcagggtcctctctccttggggaacccgttttcattgcatggtattgtcccctaaaggcctcttcctccccacaggtcagggaagaaggacaagcactcacagagcccaagagctgcggggcccagggaggggcacagccatagccaccaccaccaccaccggggctgacaccctgccccacagggaatggccttggcctgcccagcccaagatcccagcgttatctaactcctggagggtggactctgtcctggcttgtttggtgtcctcagatatctttcacacagtagagcaaaatcaccagccctgcactgatgtcactttatgtagaaaaaggccttagctggacctgcgttgccgtctatgcaaatgcatgcaaatactccaggccctgggatgtgggcttgtgttttgtcactgtgaagggggagatgggagaggagcctgttttggggtggggtctggggaaggcaatctgattctgaagctaaagagctttcatcctcttgagtgtatgtccccatagtgggccccttgacccacatgctgaccggtgccttgggatttgactagagttgctggctcgaggcccagcacgaggacttaccctggggttttgttaggtttggaagcagctgtccctagggggtgaagtcccccccctttttttttttacccctgcttctcccacggcttcacctccctatgtgaactgtagactcagatcccaataaagtgctgttgcagctatgatgctaggtggtttctaagcacaggggacaccccacaccccctgcctgaatggatgggtccatcccaggcactggtacttgcccccttgttctgtatccccctttgcccttgccttgcccttccaacaaaccctaggcccttgagaagctgatacttctccttttgctcacagctgccttggccccacccctgggagatgtagcaaattgagtgtgggttttggagtctgagcctcaggctcaaatccaggccaagtgatcttgggcaagttaatctctgggaactttgggtttcttatcctcaaaaaaggcgatggaagggctggggaagtgattaaataaaagcaacgcaagaaaaatgcctctcctgttttgggcactcaaaagttattgccttctttagggaagggtgtggaggagggaaaagaacccaggcccagaaggaagagcttctggggctggggaggtgagggaaccactaggtggcaccctggctccattttgctccagacctcgcctctcccactactcactgtccccaaatctcagacctaccccactgaccccagcgcctgctccactggccagctctcccaggatgaccagactccccttggctattctctaggaagtccttcctgagatctaaccttagtcccttcggcaatacactgggctttttgatgaccctggaaatgcccaggaagtacaggagacagaataatgtggtgtgactgctcaggcaggaggcgggggactacaggttctagaaggggctgtaactgatttctgtattatttagcaagcgaatatgtaactctgtttaagggcttaaaggtattagttcattgaattcatgtgtgggtggggcaggggttagggcaggctggggatggaacaaggaccactaattcagcaaacatttataaagtctactgtgtaccagaaacagagaggcactgggaatacagaggcaccttaagaagcctaaagttgggtcgggtgtcgtggcacacacctataatcccagcactttgggaggccgaggcggacggattgcctgagctcagcagtttgacaccagcctgggcaacacggtgaaactccgtctctactaaaatacaaaaaattagccaggcgtggtggtgggcgcctgtagtcgcagctactcgggaggctgaggtaggagaatcacttgaacctgggaggcggaggttgcagtgagctgggatcgtgccactgcactccagcctgggcgacagagcaagactctggctcaaaacaaaacaacaacgacaacaacaaaaaacagagaagcctatagtccagtggaaactttctacagcaggaggaactgcagttagatctaaggaagaacttcctttcaggtagaaggtcagtgatatgggctggggaggcttaggatttggtacccaggcctgtgaaccactgctccttgaagaagcctagttttaccctgttcacattgctcaccttctgtaggtgctcaaaattcttgctgcctgaacagctgactggtaaagttgggttgctgagagacagattcaggctagaaggtaggtaggattcagtgtcctggggcaggtggctgggctgggaaaggggatacaaactggcctacctgagttcccagagggtggtgactctcactgtgcgccttgggcttctcagtttcatttntagggctcatttccttcgtttgcataacgaacgctcagggaggctgccagttcccctaagccccctcctgttccttacccactcaggaagtagatatgctgagctggaggtttctgaagctgctgaatcaggaagaaaaagccacgaacccaaggggtatgttggggagggctgggatgccagtgacattggctgctctgatcgccctctctctgggatgcccctgggaggcgatcctcgcactcatcacaggccacgaggcccctctctctaacacacccatgcagcactggtggtgaggaggagcccagggtccaggtcttcggatgatctcctgaccatgggcccagtgtgtagagatgagtccagggaggctagagccaagggacagcattccctccttcccacaggccttggggatagctctggcctgggcagggcttcggggagcttgtgggtagactcactggatttcaccacgtgtctgtttggcctcccagggtttgggctgggctcttccagtttcagcacttggcatttttagcacttggctttctgccttttccgctgggagctccccaagtttgcccaagtagggcctgcttccctgagagctgagctcaggggtccttgggaagaatcactagagttaggggtggccttcttgggccttctactctcaaatggaaaaattctatttcctttggccagtcccaaaaactcatttcctggtagtccccagtctgcattcccccctcccgtccttatctctcattcttcagcctcacctgcttcccaggctccttcagccaccctttccccagtgccctcagcccagcctctgccacccatgccctgtctggccctgtgcctcctccaggatctcccccgtctcctgctgcctccccaggtcccctaggccccaggctttccccattgcctggcattcacacccatcctggggtgacaggtggtggagacagatggggtgggtgggtcataggtggtagtgggtcacttcgcttcccagcctgaccacccctattggcttctggaaggtcagaggcacattgctccttttgagagtggctcccagcctcgtccggctgggcccaaggacacacactggactggctggctgttgccatgggaacctcccagggttaccctgacacaggaatgtctcctcatcctgcctggttctgggccacagatgttcctggccccttcacatgctcacagcaggggtctggtagggacagtgcaggttgcagggtaggggtgtggagggctgttgcctaaatcagacaacaggttcttcccctccccaactcagctgcctgagccacagaagccccttgttaagcacttatctgagttccctgtcccacctctcccaggtctcccttaaggtggccacccatctctttggtaacctttggcacccaggataggtgactgccgctcccaaatggagaacaacagtgaaccccttccccgctcacctgttcttctggctgggcctgttcctggctcacctgttcctgggccagggggctcccagcccagatcttttctaaccagagctttgacctgagcgagatttgaagtcggaaaccccagagtggcggtctccaccgctgcccacctgtgggccttgggcaagagggctctccttgcttaagggctcagctttctcatcattgaagtggagaccacagactctgctctcagaggctgtcccgagggtgagatgagtcaatgtaagatacatgaaaaggctttgcaagctaaagggcactgaaacagagcagttatttttattgtacttaacctctaagggggaaactgggagccactgggagctactgatatgggaggaaagggtgttggttccccgatgtggcaggagctggcgggaaaagatgctaactagcattcaggtctcaatactgtgctagatgctgtggggccccccaatccttgccccgaggctaattggattagctgcatacaaagcagaattttaatagtactctcttaatggtgccaggagcagtctgccaactgggtgaagaggaagaaaggggtggcctttgagttggatcttgaaagataataggatttcagagatgggagaatgggggaaggtatttcaggctaggcaaaggtgaggcctgaggtaagggtgttatagcctatagctagatggttcacagagggggcaaattctgccactggcagcctgcaggtctgaggggatggctactgtaggaaatgggaggggtgccactaatcctcaccattccccccaccctccacttcctctccagagcagggcccctttgcaggagttctcaccagcatggggcacttaccttcgctcagccccaggggaggcattcagcagaggggagggtcatccattgaggtcatcactgagactctgttcaaaatcaaagggacaggtcatctggctagagcaggataggcagacacctgaagccacatgctgtggagaggaaagtgctagatagctccctttggaaggtccattgcccatgggtcaaacaggc

SEQ ID NO: 12750 - DNA, 12493 bp, Homo sapiens
agcgtgaaggagggaccctgaggtagagggtcaggggttagtgaggccggaagtgagtgtaataaagtttctccagggaggcagggcccggggagaaagttggagcggtaacctaagctggcagtggcgtgatccggcaccaaatcggcccgcggtgcggtgcggagactccatgaggccctggtgagtcttgacttttttctccttaggtgactcactctttcaccccggaacccctctcccgggaccccacttccggtcttcatttataagtcccgcccctgagacccctctccccggaagtcccacctcccaacttcagggggctcccccgaaccccgacttgatttttattttttgtctccgaccccaccctgtcgcccagtttttctggaagtccccaccccccgacacgttccaagccctactacgagaaacccttcgttactccttccattctccgaaactccgcctcctagcaacgatcctcggctaactcctgtcaaaaggcctatctcccaaaagggcaaaaccctgctcttcaaagaacgattcgaatttgttgaagctccgcccctccgaagccacgccccctccgtaatccacgtctgactgtccagaaagcctccccgcccagaagtctgaagttcgcgtccttaggggaccacgcccccttaggagctttatctttgtgggacctgggtcatcagctgaaaagccttgtcgtcaatccctgaaactccacctgcttatattttcctgtcctttctctttttgggccttgggatcagttttccgagcactctcgtgctcccccaggtgggaagtcaaagttcccatctctggctgtaaggagtgagattaaaggcagccgttttccgttttcctttctatcttttttttttttttttttttttttaagacggagtttcgctcttatcgtccaggctggagtgcaatggtgcgatctcggctcactgcaacctccgcctcctgagttcaagtgattctcctgcctcagcctcctgagtagctgggattacaggcgcccaccaccacgcccggctaatttttgtatttttagtagagacggggtttccccatgttggctaggctagcctcgaactcctgacctcaggtgctccacccttatcagcctccttaagtgttaggattacaggcgttagccactgcgcccgtccccgttttcctctttcttaacctcctccaagggtagaactatttgaaagggctgaacgtggggtttggcacgagagggagagagagacttgccctcagactcccagcctcacttcctggctttcccttcccaggaccaacctcatcccagaagtagctctaggccttcctagacataagtggataagaccatggatttgttggtgtgtggcatgtgggtgtgacatgagcaaaagttttctactaccagaagaacggtagtttggagtgggggtagataatagtgctctttttgttgtttgatttttttttttttaagggacagttcagtcgctacttctctgtctcttcccctccccctaaccagagttcttgtctgggcattcctcctggccccgtttgcccagccttccctgctggaaacattcctgaggctttcgccatttcctgccacttcccgcccctgtcccctcctcccagttgggctgcgaagccacacacagcttttcccctacacccaatcacctggacttccagtaggcaatctcctttctccctatgtaaatttcaagagtcatacgtctttcttttcttccgaacgcccacacccgttggtccttccctggctctggatactgtaggctcccacagaacatcatctctacagatgagggacatcctagtgtgtgtttgtgtgttttgggggtgtgaggctatggtggaatcctttcctcattctctctatgcccgagagctggctggaaatgaagtgataaaattccttctcaggattggctggcagagtgacaaagctcttctggaatgagcactaaggggagatgtaagagttaagcacagcatctaacacacttcaagtgttaatgttgttaatcaggataattatctatctatattttaattctctgaagtaaatctaagggtaattccaaggtgagctggggggaatacgtatttttttttttttgagacggagttttgctcttgtcacctaggctggagtgcaatggctcgatctcggctcactgcaacctccgcctcctgggttcgagcgattctcctgcctcagcctcctgagctgggattacaggtgcccgccaccacgcccagctaatttttgtatttttagtagagacagggtttcaccatgttgaccaggctggtctcgaactcctgacttcaggtgatccacccgcctcagcctcccaaagtgctggtatcacaggtgtgagccaccgcgcccggtaggaatacgtatctttgtttttttttttttggtcactttccagctttgcctgtggcattctccggaagagcagtggcaggaagccgtgggtggcaggaatgggtttgggactgttccctgtgtccagcttcaacccatcttctcctgacacccctttctcctgtacttatttttctcctgtccttattgacgcagatgtgtcttctgatctctctgtcccttcctggcctgtagtttctacttctcttggagaactgtttcttccacctcctccagccaggctccttccctggtgtgaaggatgctgtgctctttggtggggcttagggccctgtaagaggagggatgtgaattggggtggtttggagtgggagtggggacctgattgcctcattctcacccttgacagtgtgctgtgttaacaagccctgtggaaaggggagacaggacagtgcttggctatgagccatcggtcttggtgtggtagatggcatacgtagagaacaagccgtgaccagcatgtcctcttgttcccttcttgcctggtagcttcctgatgtatcatccaggttgaactttattccccttttttcaccagctttgctcttcctcttggccctgctctgcatccattgggaccacttacttcccatccccacttcgctagctccagtccacagctgctgtagcagaggatgctaatggcccaggcttactgtatggggtagcggttgggggtggcctgggctggggccagccagctttcgggcatagagagggtgggggaattcgagtgtccaaccaggacaggaagggaaatgctgagctctgagatctcctcccttttccacccccagctgcctctgtttcctccctcattcccctgtactcctgcctggcttcctgccccctttggcctgcgtgtgtccggttttgagtgacccagacctcctatctccttcctttccgtcccactcttccatccttccctcccacccccactttacttctccccagattactagttgtttgtatagggcaggggagaggggcttggatagccctaccccctgctccagttcgaggttggggcggggtgggggctcagcccctctgagcctgtgagtcagcactgtcctcacgattggtctctccccttagctccccgcccctggggaggagccagaagcgctgggtccagcctgttctcttctcagccagagaagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcgggtgagtgaacatcctcctctccattcccccgcagaccccctccagttctaatgctcactccagcttggccggaatctcttttttcctgctgttccccaacaaccccgtttcagtgtcctatttcctaaacctttctcatcccttccccgattctgtagccccttcccttccagctttgcctgggcccccttccttcttttcactcccccacccccaccctggcatgcttagcacaatgcccagcatggcagaagctcttaataagtgttggaatgaatgacttcttgatctttcctccattctcctcccgctttctggagttgtcactccatcccagccaatgcctgtcggtcccctccaaactctctccccagtgtgtgaggtccttctagcctgccttttctttttctcctcattccctgttgtctttcaccttggttgtgggatgtagccacgggaagtgggcagaacttcttcctctttacttcccttagggaccatatgggtaaagtcctagggccctttgtgaaggggctggggtgggggagccgctgacctgctgtcctcttctccctccccttagtacatgggttgtgtggaggtcctccagtcaatgcgtgccctggacttcaacacccggactcaggtcaccaggttagtggggagggagtggattgtgggagtcctgggattagtgaggccatgggaaacagaggaggggagtgggtcacttgggtgctgctgctgggggctgatctttgcgtagtaaaggggattgagagaaagctgaggtagtgattccgcctcttactgaaaggaggcccctttggcccggatcctccttacctatccagccttgggagttgtggggaaggtggcagaagcagctggcaggtggagctggagtagaaaaggggggtagatggaaggttgctgctgcctttgggaagggaatgggacatttggtagctggaagggggtggggctatacccattgaggccctaacccaatcagccaggaagtggcctctcagtgtcatcaaatattaaaggcccttaattcaatccaccatgacaaagagcctggagtgccctgggagtctggcctggctttcccctcccccagccctgtggcagccccagttgagtgggaggcaggcaggcaggcgctgggtctgagtacccctctttccccagggaggccatcagtctggtgtgtgaggctgtgccgggtgctaagggggcgacaaggaggagaaaggtacttggggtccttggggatagggatgctgctgggaaatgtggaggggcagtggggaggcaagtgtggggcatgtggggagagggccaggaggcaaaagtgtggtttgcctgtgctgggaaccctcaccttctgagaccctgggccctaccttagccctgtagccgcccgctcagctctatcctggggaggagtaacctgaaatttgctggaatgccaatcactctcaccgtctccaccagcagcctcaacctcatggccgcagactgcaaacaggttggtgaaggtgggcagacggaccagaaacactgatgggggtgctaaggggagatctagttaggaggccaaaatctaggaagagggcttgagagcaggagaccagtagggaaggaggaaatgaggatatgggataaggaacccagagaatgagactggggcaccagggttctgggccctgaggctgcctgacacatggcattcccttccttcttcatcccctgccctaattctcagatcatcgccaaccaccacatgcaatctatctcatttgcatccggcggggatccggtgagttggggaacagagcaaaggcggtgggagaagagcaaggggctagggattgggaagacattgattagagaagtgggggtgctaggattgtggggatatctgaaaaggactgggttttaggggtcaggagtaaagtagaactgtaaaattttttgaccttcctccccaggacacagccgagtatgtcgcctatgttgccaaagaccctgtgaatcagagaggtgaggcatggtggggagcactgggtgggtctggctgtttgaggaggtgagtaggacctttggtcatctgtacccactctaagtagatctcagtgggggttcctgcagaggaagatgagggcccctgtctgtgcctcctcccagtgggctcagctcactgacagcctctgctgtgccctcagcctgccacattctggagtgtcccgaagggcttgcccaggatgtcatcagcaccattggccaggccttcgagttgcgcttcaaacaatacctcaggaacccacccaaactggtcacccctcatgacaggtgagcaggtggggagagtgtggagcagctcttggattaggattaggaaaggagggctgctcttcctacacttgagttgagaggttcagggagggaataacctgtgtgcctctgcttcccacttcctgctattcttctgtttcctgtggcccaggaggaaagacttttgaggccctgcttgccgcaggaccagcttttcttgtttgctcatggtggagttgtagtccggggcctccaagttacatctctctctggctaggtgggattttctactcccatccctctttcttgctcatttctctgcttggcattatgtgttttcctgcctctagaagccatcaagaatttgggtttgggaggatatctcttttccctgagattacaacctttcccacctcaggccttgagggataagcagtggagccagtagggattgaatatttaggagaggttaaaatattctggagctggagtgcctcccccggccccccacccccctacatggtgcttcccttccttgttgggagatagcacagagatcaagagcaagagcattacttatttgagacagtcttgctctgtagcccaggctggagttcagtggtacaatcacagctcactgtagcctccatatcctgggcttgagtgatcctcccaccttagcctcctgagtagctggggctacaggtgcatgccaccacacctggctgagtagtagtatttttattctggtagagataaggtctcgctatgttgtcctggctggtcttgaactcctaggctcaaacaaccctccctccttggcctctgaaagtgttgggattataggcgtgagccattgcacctggccaaggggatgagctttaaagtcaaacctgaatttaaatctgagctcggccgccttttagttgtgagaccttgggcagatcttttcacctctgaccctcattttcctcatctgtaaaagtggggaaggaaacaatacctaccttacggggttgccaggagaatgaaatgattatgtatataaaacactcagcctcaggcttaatccatagtaaatacccaatagatggctgctgttctattctgtccttccctcctcctgcccaccacacatttacagccacagcttcactgtcctgtccctcaggatggctggctttgatggctcagcatgggatgaggaggaggaagagccacctgaccatcagtactataatgacttcccggggaaggaacaccttggggggggtggtagacatgaggcttcgggaaggagccgctccaggggctgctcgacccactgcacccaatgcccagacccccagccacttgggagctacattggtaagttgcttggatggaggcgggctggggctagggtgggagtggttggttagggcttctggtctcaccttatttttatccctgcagcctgtaggacagcctgttgggggagatccagaagtccgcaaacagatgccacctccaccaccctgtccaggtatgaagggagccgagataggcagagctggggagtgttggaggcagggctgggatcactgtagagcctccctttcctcagcaggcagagagctttttgatgatccctcctatgtcaacgtccagaacctagacaaggcccggcaagcagtgggtggtgctgggccccccaatcctgctatcaatggcagtgcaccccgggacctgtttgacatgagtgagtgctcgtctctctcctctctgcatccccacctttctacttggttctggcccttctcctgcctatctgctctttccttcctgacttcccttccctgaagtctgggtcttgggtgtgtgttgtgcctgctacttcccctcaccctccctctatacttccagagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggtgagtgtggcagaggtgtgggtgaggggtggcaaaaaggaaggtacagtaccctacagtgtatccctcttccttccctcattgctttgtagacattcccgctgggcagctgtctatgggcctctcttgctctttaaagtgtctggcatcttcctccagaggctcatcccttagcctgaactatgttctttatagtcctggcacagggccaggcgtggtggctcacacctgtaatcccagcgctttgggaggctgaggcaggtgaatcacctgaggtcaggagttcgagaccagcctgaccaatatggtgaaaccctgtctctactaaaaatacaaaaattagccgggtgtggtggcaggcacctgtagtcccagctactcaggaggctgaggcaggagaattgcttgaatctgggatgcagaggttgcaatgagctgagatcacaccactgcactccagcctgggtgacagagtgagactctgtctgaaaaaacaaaacaaaacaaatacagtcctggcccgtcctcaaatccccaagccttaagcttatcagagctagaaggcagtcatctcatctgtgcccctcttttgacaaataaggaaaccaccctgaagaggttgtgatgcccaatgtcagatggttagaggctagacactgcaagtttccttttgtaagaagatccaagggcttctccagctccccagactcaggactcagaccactgtgctttctcttatctgcactgcctcactgttcttcaaaactttccttgtttagccaggtgtggtggttcatgcctgtaatcccaacattttgcgaagctgaggtgggaggattgcttgaggccaggagttcaagaccagcctgggcaacatagcgagaccttgtctctagtcaggaatggtgacacatgcctgtagtcctacctacccaggaggctgaggcctgaggatcgcttgagcccaggagttcgaggttacagtgagccatgattgcgccactgtactctagcctgggtgacagagaccctgtctggaaacaaaaaaacttttgtttgttttctacagtaatctcagcttcctttctttttttttgagatagggttttgctttgtcactcaggctgcggtgtggtggcacacctggctaatttttgtattttttttttggtagagatggggtttcgccatgttgcccaagctgttcttgaactcccgggctcaagtgatccgcctccctcggcctcccagagtgctgggattacaggcacggaccaccatgcccagcctccacatctttttttgcactgtgtatactcttctgagacatgccaacttcctccaggtcaagaaaggggtatatagctctcagcttcactctttcagggctgatgtcgcctttgccttttctcacttcactgacctgtctattcctacaactgtctctttctagagaagcctcaatgatcaggattgacaggccacactctcccccaccatttttttctcctccttcaagcctcttgtctgtttcaccctcttccaccttggaggctgaggtcttatttgactcttcacctgaattgaccttcttccttcccaccctcccaggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggccagcctaggcccggggtggcacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctacctctgcctcttaacccttctgggaagcctattgtgtacgccgcgggccctcagcggcagacggggaggcgggaggtcgcggccgcccagggaagctgggggtctgcagagtttgggtgcggcagagtggggcgtttcgcgccaccgtccccatgggatgtcgtgtccgcagagggggctggctccgggtgggtcgaggcgggaacggcctgccggcgccccagcaccggcccccgggctacctgggcctcccgggtgcgccttcggtcgcgcgcgcccctcctcggcggctccaccgcccgggatggtacggtccggcagccgggccgcgcgctgccgcccctcggtgagctggtgtgggccg

SEQ ID NO: 12751 - DNA, 3284 bp, Homo sapiens
agaaaagaaatttagagtatgaattgagttggttgagagtagaattaaaaagatttctagcactttgagcatgttttagaaatttgatccttacatttaaaattatgtaaatgacatctttcactggcatttgctcacatttaagtcaatctacagctgttacttactaagctaagaaataagaagatccctatggttctgaatctctcataatattctgaagtaatttatatcaattgaattttcattaatcattttaggaaatattatgttttattttgtggcattatatgacaatgactttctcaacaatagctcagggaatacgcaaacagccagctcttttatgtaagaaagccattttctaatccccacgctttcctgagtgttacgtattttatttctttgaaaagagagggccttgagtaaatgctttcgtttgctttccttacatatttagaaatccaagaagggcccttgtcttagtctatttctgtcacagagaaattgttcattccaaaatatccaccttaagggaagctagtgaccgagatatggagaaaaacataggcattcatgacctttgtgtttccgtttgactttcaacatctgtaaccaaaaggtcacaaatgaaatatttagtagaaagtgcaatatcaatttattaggagtacctaaaattataactctaaataatatacagcaatattattgctctattattacagcaatcaataatataatatagccactaggatacactcgctgtagaactcagaacaaaagatatcaatcttctgccagtccgcatcattatgtgtagcagagactttactggaatgagtgaggggaaagataacaaaatgtagattaggattccacattctcccctgcccatcttcttgattgctcagtttgaagacgatcattgatggacaaatactttagaaatgaatgaagtcaatagctaatgtttctcccagaaactaaacaacatagtttaggggatattaggcctacattctaatcacattgtaaggaagtgattttctaattttgaagcttcccaggagcagccccctccaggaacaattttccctgtgaactttcactgagaaactattatatgccatggaggagtcaaagatgaattaaatccaatgctatcctccaggagtgagctttgtagttggagagaaaagccaaccttatagatacaacctgtacatatataacctatgctgcatttaggcagatgataagccctaggaatggaaagagggaaaagctcccttttgccaggaatgatgaaggaaagctttatggaaacacaggctgtatgtgaaagatgggtgaatctttgcaggtagggaagaagtagggggcatgtctggctgagaaccggcctgatcatagagtggaaaaatgaaaggcagaggtgaaggaagaatactaaatgtgaaaggctgaaatacacagggaagtgttgccagtgtgcaacagaatctcatctcgtgcaaaattgaattagacttccttactccttccttactctgggtaggtccatgtgcagcctttcctcagagcatctagcctgacatacttggctcatctgctgtgcttctaagccaaataaaaatcatcaaacacatcgaagatatttttgggagtcaccaggttaaagcaaagcctcagtcactgaaagcaaaaactgaattggccaggtctccactgacaaaacagagtaaatgatagtatgacagataatttcaagttttccaagactccaatttctgaaaaatgtctcatgactccaaaaaatcacgtacttcctaaaatgttgccagtggaggaccgaatcaaggttattgctgacctcattttttcaaccttttcagttatttgacctgaataggcaatcccccaggatttctgattgaattctacctgaaagtttagattttaaaagacaacctgtaggaagctaagtctcaggcaacaaaatttaaaaccatcagaacttgtttctccaaacatcaacctgctcctgtcaagtcctttttcatctctcccttttgtccctttacatactgttttgtaagttccttttgatatcatttattgcaggcagtatttttacatccatcttcaagaaacttgggagacatttagacatttagtatgtgtacttttagttgtcttgcctctttatttcagataatgcctgtgattagtgaatggcggcattattcctgaagacaaatgaaggaagatagggagcaagattgactgtcatttgaatgatggaagagaagtagaattactgtgaggttacaaaaatcgtaagttagcagacattgagaaaggaaaacttcctacttgggcttttcaggcttatgtgacattatctggatgtgttttctagtctttcctaaaggagaaatttttattcctgggttgctgaaagctttctggactaaaaggatataagcagctcaatagcagcatagaggattagattaatggaacagcactgcatacaggaaagctacatctccaatagtttaggctgcaagtcagtagccaaacacaagagcatgtaagatttggaggacaaagtataaatattttaagtttacacaaccaagattataggctaccttcccaacttctaatttgaagagcactgaaaatggagctgtgaacacttcatttttaaaacctgacaatatggtgctattgactacttaatacaaagatatattacaatatttttaggtaaatgtattaagtctggcctgggcataaatgtacatacagaaaatgtttgtagagaattcatcaaaatcatgcccatttgctgttgtagagctacagtattcttcaatggtggtgactgaccagtgagtttctacttcttacagatgggacacaacagtcatgggctgtctcagctgcccaaagcctgaggcagaccacatgagagctgtggcttcttcttggattcaggttggataacccaattcagtaattaaatatgtaaattttggggggggttggggggtgttttctaggaacttgaagagtacgtgacattataaaaaatgggtgttggaagactaattgtagaaatttgacctgagggccaatgttacttggtgtaagttcactcagacagacatgtcagaacatgcccaaagaagcctatatcttgctgctgggaaatgtaaagcagttggcatgtagaatacgataataaatcatttaagaaaccaccaaaactt

SEQ ID NO: 12752 - DNA, 3284 bp, Homo sapiens
agaaaagaaatttagagtatgaattgagttggttgagagtagaattaaaaagatttctagcactttgagcatgttttagaaatttgatccttacatttaaaattatgtaaatgacatctttcactggcatttgctcacatttaagtcaatctacagctgttacttactaagctaagaaataagaagatccctatggttctgaatctctcataatattctgaagtaatttatatcaattgaattttcattaatcattttaggaaatattatgttttattttgtggcattatatgacaatgactttctcaacaatagctcagggaatacgcaaacagccagctcttttatgtaagaaagccattttctaatccccacgctttcctgagtgttacgtattttatttctttgaaaagagagggccttgagtaaatgctttcgtttgctttccttacatatttagaaatccaagaagggcccttgtcttagtctatttctgtcacagagaaattgttcattccaaaatatccaccttaagggaagctagtgaccgagatatggagaaaaacataggcattcatgacctttgtgtttccgtttgactttcaacatctgtaaccaaaaggtcacaaatgaaatatttagtagaaagtgcaatatcaatttattaggagtacctaaaattataactctaaataatatacagcaatattattgctctattattacagcaatcaataatataatatagccactaggatacactcgctgtagaactcagaacaaaagatatcaatcttctgccagtccgcatcattatgtgtagcagagactttactggaatgagtgaggggaaagataacaaaatgtagattaggattccacattctcccctgcccatcttcttgattgctcagtttgaagacgatcattgatggacaaatactttagaaatgaatgaagtcaatagctaatgtttctcccagaaactaaacaacatagtttaggggatattaggcctacattctaatcacattgtaaggaagtgattttctaattttgaagcttcccaggagcagccccctccaggaacaattttccctgtgaactttcactgagaaactattatatgccatggaggagtcaaagatgaattaaatccaatgctatcctccaggagtgagctttgtagttggagagaaaagccaaccttatagatacaacctgtacatatataacctatgctgcatttaggcagatgataagccctaggaatggaaagagggaaaagctcccttttgccaggaatgatgaaggaaagctttatggaaacacaggctgtatgtgaaagatgggtgaatctttgcaggtagggaagaagtagggggcatgtctggctgagaaccggcctgatcatagagtggaaaaatgaaaggcagaggtgaaggaagaatactaaatgtgaaaggctgaaatacacagggaagtgttgccagtgtgcaacagaatctcatctcgtgcaaaattgaattagacttccttactccttccttactctgggtaggtccatgtgcagcctttcctcagagcatctagcctgacatacttggctcatctgctgtgcttctaagccaaataaaaatcatcaaacacatcgaagatatttttgggagtcaccaggttaaagcaaagcctcagtcactgaaagcaaaaactgaattggccaggtctccactgacaaaacagagtaaatgatagtatgacagataatttcaagttttccaagactccaatttctgaaaaatgtctcatgactccaaaaaatcacgtacttcctaaaatgttgccagtggaggaccgaatcaaggttattgctgacctcattttttcaaccttttcagttatttgacctgaataggcaatcccccaggatttctgattgaattctacctgaaagtttagattttaaaagacaacctgtaggaagctaagtctcaggcaacaaaatttaaaaccatcagaacttgtttctccaaacatcaacctgctcctgtcaagtcctttttcatctctcccttttgtccctttacatactgttttgtaagttccttttgatatcatttattgcaggcagtatttttacatccatcttcaagaaacttgggagacatttagacatttagtatgtgtacttttagttgtcttgcctctttatttcagataatgcctgtgattagtgaatggcggcattattcctgaagacaaatgaaggaacatagggagcaagattgactgtcatttgaatgatggaagagaagtagaattactgtgaggttacaaaaatcgtaagttagcagacattgagaaaggaaaacttcctacttgggcttttcaggcttatgtgacattatctggatgtgttttctagtctttcctaaaggagaaatttttattcctgggttgctgaaagctttctggactaaaaggatataagcagctcaatagcagcatagaggattagattaatggaacagcactgcatacaggaaagctacatctccaatagtttaggctgcaagtcagtagccaaacacaagagcatgtaagatttggaggacaaagtataaatattttaagtttacacaaccaagattataggctaccttcccaacttctaatttgaagagcactgaaaatggagctgtgaacacttcatttttaaaacctgacaatatggtgctattgactacttaatacaaagatatattacaatatttttaggtaaatgtattaagtctggcctgggcataaatgtacatacagaaaatgtttgtagagaattcatcaaaatcatgcccatttgctgttgtagagctacagtattcttcaatggtggtgactgaccagtgagtttctacttcttacagatgggacacaacagtcatgggctgtctcagctgcccaaagcctgaggcagaccacatgagagctgtggcttcttcttggattcaggttggataacccaattcagtaattaaatatgtaaattttggggggggttggggggtgttttctaggaacttgaagagtacgtgacattataaaaaatgggtgttggaagactaattgtagaaatttgacctgagggccaatgttacttggtgtaagttcactcagacagacatgtcagaacatgcccaaagaagcctatatcttgctgctgggaaatgtaaagcagttggcatgtagaatacgataataaatcatttaagaaaccaccaaaactt

SEQ ID NO: 12753 - DNA, 3284 bp, Homo sapiens; identical to SEQ ID NO: 12751

SEQ ID NO: 12754 - DNA, 413 bp, Homo sapiens
tttaaaaccattatcttagaggttaggattttaacatctgcgttttaggggaacacaaatattcaaaccatagtaccagatgttttattaaatgaggaaagtaactccctgcttcacagtcatattttctattacatacttaccacagcatccctaactgccttcttataacatagatcgtgggtgtccttgtaatcacttttagtttttttcaattccaaacaaaatatcataattcctaatcaaggtaacacaattatttcaacatgtgtacaataaatcctgtccataatttacaaaggcacaatatattatttgttctgaatatataatagcaaataaagtttcagcagtattgtataacagctaatattatatgagacactggcaggagagatcagcatgtgtgttgt

SEQ ID NO: 12755 - DNA, 683 bp, Homo sapiens
tgtcttggtttgctatgccttatcccagatcagtgttttgttccatccctatggtcatctctaaagccctgacaggagcatcccagactggagaaatgcagcgtatctgtggcccagaattttgtttgatactctaaacagcaatgcaaagactgcaaaatcacactattctaaacagttgttttcagctcattttgaagattgacctggaaaacatatagatacagaatatatacatttaatcgttgcttgtgattcattgtgtcaaaataacatttaattttcactctgattaatctttattttccatttaaaagattatttcaggctacttaaatacaagaccttgcattctaatttttgaaagcggttgttttccctgagctctctctcaactttgacagtttgtgaatgataaaaagttactaggtttgtcctttccttgatagatgtagagcagttcatctgttttgtaaaggtacagttaagcataactataggctgggcgtgatagttcatgcctgtaatcccaacactttgggaggccgaggttggcagatcacctgaggtcaggagtttgagaccagcctggccaacgtggtgaaacccctaatacaaaaattagctgggcatggtggcacgctcctgtaatctcagctactcaggaggctgaggcaggagaa

SEQ ID NO: 12756 - DNA, 413 bp, Homo sapiens; identical to SEQ ID NO: 12754

SEQ ID NO: 12757 - DNA, 683 bp, Homo sapiens; identical to SEQ ID NO: 12755

SEQ ID NO: 12758 - DNA, 413 bp, Homo sapiens; identical to SEQ ID NO: 12754

SEQ ID NO: 12759 - DNA, 8061 bp, Homo sapiens
gttatctgctgccttggtacccccccgccattacacaagagtacattttaagcacattacacctgagtgattgttgtaaaacacagatgcaatctttccaccatcctctaagaattcttctgtggcttccattggttaccaaaaaaagtctgtgtccagtgcacaagaccatgacccagctcagcctggtccttgcctccttgtctaactccctctccttcgggtatccaggatttgttcgtgctaacagacagacttctctaataggtgaattccttggtgggggtgggtggcatgcctttgcatattgctttctctctgctgagaatgcaagcctgtccctagccgtttctgccactcctcctgatctggtgagtttgatctgcctttcacaatgaatcccagtcagtaaatatttatcactgacatgctgaccctggcaaaaattgatgagagactcaactaaggcagtgatagtgaaggtacagatttgacatctggttaggacatagggttgacaaactttgtcactctttaggtgtagaggaaatacccaatgaagaggttgaaaatgtgttgagttttacaattgactggagctttctaggggccacaataaaggcaattggtgagtatagttgttttaaaaatatccagtatctgttaagcatttaccatgtgcagggatatggcaggcacttcacattaattgttttatttattccttaacaacagttttgtaaggtaagtagtattattaaccctatttacagatgacagaactggggcttagtgaaagtcttttagaaacaaaatcttggtaccttccatatatacctaaagtgtgaaagtaattgggcctggggtcatagagctgtatagattttttatgataattggaaaatgtataatcttattatatatttatgatgattattaacttgcatttgaaggctgtgaacagggcatatgcttaaattgctgtggcctaacaattcctgttgttacacttgctcaactcacaggttattttcctggcttcatatatgcaagtttgacattgctgttcaaagactttaaatttagaattctcttttaaaaatgtaaatgggattttgccttagaacagcaagccactgacattttgtgcagaatgtagtatacataatgcagagttttacacagaaaacttggcaggcatgtgtggaacggctgcagacagggacagcctataattgtgggtgcaacccgcgtgtgtgtagggaggggggtgaagcagcgagaagggtggagggcagcagctggggaccagaggagaagtagtgtgactcggtgaccaaggagaagaaaagggtgcttccacagttttgaaaataaggagtttgccaaaaattgtaaagtctaaatgcagaccttgtttggaataaagatgaatttcgttttagctctgtatcctttggcaaccctttttttcccctctcattttttttcctgcgtgaaaaagagggaaaggggtccatccagtcatgcatatgaatgtttctataccagagtagtaaatatatgcatcttatgccttcgtgtggtcctttgtaactgtgaattatgattttggaaagctgtgtttttttaatcttgtttctgtaaggataaattaatcaaagttaacctctcaaaaaagtcctggttctgtaggggggaaaaaaaacaacaactgattttcaaaaatctattagtggggaagactatattatacaaatagtcatgagcatttctgggaactggcttccaatatcccagacagcgtgacctgaatgtgaaaaaagttgagaccactagttttgagccaaaatcatacaagcaaagagaaagcaagctgttgcccaagattgtggggtaaccatatgtttgagccaggacttgatgaagtaattgtgcgcaggaccccgtaggggtactgggccgtagcccacagagcactgcaggcccctgctcaaagcagaccacatgaaggcccacacagactgagtctggtcctgctggtggccgcagcaagtaagaaacaaagtgggttattaacatccactggaatcttaacctcatttaaaggaaaacttgactttgagttaactgtatcccccccaccccccgctgtcaagaacccacctctctagctcattcctgtgtcagtgttgccgtattaactgcccacctgctgctttgtaaaaggagactagagtttacccttcttattttagaatgttttgaattctcttttttaatgcaataaatttaatttaccttttttttttaacctacaataagattgattccttttggtgtacagtcgtgttgtgacttttgacagtgcattcagtcatgtaaccactgcccataacagaaacatagatcggttctgtcacctctcccctgccccagatgttcttgtgttgcttgtgtacagtcagtcctgtcctctacccccagccagaaaccagtaatctggtttctgtttctgtttttctgccttttccagaatgtcataaaaatggaatagtatagtatatagcctttagtctggctttgttcacttaccataattaatttaaaaataaatgtcttaaagcgtagaaaccatgatcattttaatttgtaatggagaaattttttattgcttttagtatattgagaacttgtggatcacactgtatttgaaattattaatgctggatgttaaaaggtcactaaaagtatgtactttttagaaaatttatttcactgtattttattagtattataccttatatactgagtctgggacatagaagtcttaatttctactgcaaaatggatttttttttttttttttgagatggagttccgctctcgtggcccaggctggagtacaatggcacgatctcggctcaccaaaacctccgcctcccgggttcaagcgattctcccacctcagcctcccaagtagctgggattacgggcatgcacctctatgcccagataaggtttgtatttttagtagagacggggtttctctatgttggtcaggttggtctcgaactcctgacctcaggtgatccacccgcctcagcctcccaaagtgctgggattataggtgtgagccactgcgcccggccgaaaatttatatttttaaagcgaaagctaacttctaattttgaaaaattttattgggagcaggatattataataataatctttagttgttaaaccattaaacatcaggttttttacatagtttctatgcctcctccctcaaaaaaaaaaaacctcctacaataaaactgaaaaattgcacaaagacatattagtggaagaccactgcttcgtttacacaaatgaagagtataaagcagagaagtgctccttggggcaaaaggcaattggcaaaaagctaaggaacattttcataatgagttagaaatacagatcatcaggaatatccaggaagcgatagtgaataccaggcaggcttaagagacaggaaacatttagcatgttggtaaaccactttagcacatcagcaaaagcatataaacagctttaggattggaaattattgccatggggaaaggcaacaatttagaggagcaattccaattaaaaatataaagatcgtttctttagattaattcttgagttgctcccctatgcctgtgtagcagaatctaaaagataatcatgtgaacgggagattatatttaaaaaataaactttgaaattcataaaaaggaaaatgttaaagaatgtaaaattatactggtagaaaaaaaatttttttttttgaagatggagtttcactcttgttgcccaagctggcgtgcaatggcacgatctctgctcactgcaacctccacctcccaggttcaagcaattctcctgcctcagcctcccaagtagctgagattacaggcacgcgccaccacgcctggctaattttttgtatttttagtagaaacggggtttcaccatgttggccaggctggtctcgaactcctgacctcaagtgatctgcccacctcggcctcccaaagtgctgggattacaggcatgagccattgcacccggcagaaattttttaaaatagaaaaaaatagcccattcatgatacatgaattaaagaaaatattggtaacatgtatggtaacagattagtagctgagaacccaaaggctgccccaggttgcttcaaatcctggttctgccatgttccagctgtgtgaccttgggcaaactatcttaccctttgtttcagtttcctcatcaggaaaatgggctttaataggattattgtgtggattgagttaataagtaaagtgcttagaacaggcctccaaaatagtaagtgttgtatgcgttagctattattaatacatcacaaatttccactaaagaaaatcttccctagtttgtatatgggattgtcagaaaacaaatggaaaaatcatagtataaacagcctatatggctttaaagaattatataaaacacatgatctttctgaagtagttttttaaaagaaaaaagttagaactaacttctcccttgattttcactttttagagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttggtaagtgcttcttacgatctcattttaatctcattgatttttttttttaaattgcttccactggcagtgaataaactctgatgctgtatcccagaactgaggtttttcaacttaaacttctacttttggaaaaacctaaaaatctcatttccaccgttgcaactgcctcttattcatgactggtaggaatgtatccatgatgattttagagatccctaagaaggtgtttttcttcctggtagctttatattacagaaataataggtctctcccccacattttttcaaatataaattcatatgtaatattgaattccttcctcctcagacagatactttatctcattttttaaatttaaaaactagggataatgatagacatacttcacagggttcctgtgagaattcaatgaattaatacattaaggagacttagaagagtccctgatgttttctgagcattccataaatgtcagtattactgttactcccctgaggttcctgtctgtgcccccaacggctaattctttctccaccagtcattcccagtcccagcctgtatacagcctagatcttttcttctctttttaggacctttattttttcgttacttgggatacatgaaacttctgtttgcccttatacttctcctaacttctgtctttacttcttcctcttattataggatcaaacccaacaataatactgtctgctttgatttccatgccatctactccttcagtagtccctgcagcttagtttctgctttctgagcgtgttctaagattatcaataacctaagcagtttagcttgtcctggtattcagtctggtggggattttgtttttgtctttgtttagacagagtcttgccctgtcacccaggctggagtacaatggtgcaatcactgctcactgcagcctcaacctcctggactcaagtgatcctcccacctcagcctcccaagtagctgcctgcaccaccacacccaactagtttttgcttttttatttttagtagagacaaggcctcactatcttggccaggctagtctcaaattcctgggctcaagtgatcttcttgcctcagcctgccaaaatgctgggattacaggtttgagccaccacgcttgacacaagactggtgttcttaaccttgactttaaggccctgtattagtctcttcgatgtttctgtaaaacgtagctatgcttcattgcagttatgtcagcattcttatgctttccaccatgactgccagcacaaagtagattcccaggtgaattaatatgatgatgcttttcattgtaaacacacacacaaggagcttgatcaatggagtgatactcttggaaggagtgatactcttggaagaacatttcagacgttgcatctctaatgaaagctaggaattgggaacggttgagtcttaactaaacatctgtattactttaccactctgcgtatatatagtatacttcaatcaaaattagattgttacatcaaagttttaaaactctggtgattattttgttaatgacacctgttccctgccaactataacttcaacaattttttttcttttatttttggtgagcctgggtgtggggattctaacactaggtcagtagtccagagcagtgctgtagctcagcagtgttatcgtggatctgggcttttgctgtcttttccaccgtctttcttcattttattttattattctatttatttatttatttatttatttgagacgaagtttcgctctgttgccagggtggagtgcagtggtgcaatctcagctcactgcaacctccgcctcccgggttcaagagattctcctgcctcagcctcccgagtagctgggactacaagtgcgtaccaccatgcccagctaatttttgtatttttagtagagacggggttttaccatgttgtccaggaaggtctcaatctcttgacctcataatctgcccaccttggcctcccaaagtgctgggattacaggtgtgacccaccacatttttatttatttatttatttatttatttatttatttatttatttatttatttttgagatggagtctcgctctgtcgcccaggctggagtatagtggcactatctgacctcactgcaaccgccgcctcctgggttcaggcgattctccagcctcagcctccaatgtagctgggattacagacatgcgccgccacacccagctaatttttgtatttttagtagagatggcatttcgcgatgttggccaggctggtctctagctcctggcctcaagtgatttggcctcccaaagtgttgggattacaggcatgagccatcatgcctggcctcttttccaccattgttagatgggtgctgtatatccagacatcgtgtctgtagtgcagacatgaaggaggcggaaggggaatgagcagaaaggttgactcctgccatgacttttaaaaaaaaaaatagtccttatactagccagaactggttataaatccttcctttaaccaatgactggccagaaggaatgagattactatgattggtttggaatcagttgtgaatcagctaaagaatcaaagtcctccaactacttgaggggttgagatgtggggagggatgagtaggctgggatagttgttgtgtacataacagttatagctggagggttaaattatcgttgttctttcagaggagaaaatgcatagcaaaaatcttagcaatgatcttgcattgattctgtttcctgggttccaataacaagacttgtctcattttttgcctttcttgcagatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacaggtaaacttcatacaggttttaaatcatatctatttgttaaatacacatagcatcaaataactgcactccacttgagcccttgtctttgtttcaaagagtgtatttgaatttttgtggtaaatccagctggctgtcttaaaattgtaaaattttagctagcttcctcatatatactcagcctcaggttaaatcctgtgtgttacttaaaagcccttgtagaaacaagatttcattaaagaaactgaatttttcattttgggggtggttaatcttttaattattaaagtaactggaaacttga

SEQ ID NO: 12760 - DNA, 30826 bp, Homo sapiens
ctcattcaatgcattgtttattgagtactaactagctttgggcccaggctctgggttagcagcatgcgtgaaacaatcagaaacaatcatgagcgcctgcccacatggggcatacagtctggcagggcaagactgtagacacagaaataaatatccgattataagctgtgattagaggcatgatggaaaagagcaaggcttcctgagagaaacagggcgagcacaggaaaacctctctgagacagtgacatgaacttgaaacttgaagggtaaacaggagtgggcaagacaaaaggggaaagaaggaatcttccaggcagagagaaagagaaaagacccaggcacggtatagagccgaggacatttgaggaagaaagggccgccggggttggggccctctgggtgactgggagaggaaggcgccggaatggatccagattaaatcggatgctgtatgccctgtggagacatggggtgtacctctaaacgcactgcgttgtaagcaaaggagtgacctgatttaatttgatcttttaaaagtcattctaggccaggccgggtggctcacgcctgtaatcccagtgctttgggaggccgaggcgggtggaccacgaggtcaggtgttcgagaccagcctggccaacatagtgaaaccccatctctactaaaaatacaaaaattatccgggcatggtggtgcatgcctgtaatcccagctactcaggaggctgaggcacgagaatccgcttgaacccgggaggtggaggttgcagtgagccgagatcgcaccgctgcactccaccctgggcaacagagcgagactccatctcaaacaaaacaaaacaaacaaacaaaatgtcattctacactgtgaaaaatgagctggaggaggcaaagggaagaaaggggagatcagtgaggaggctgttgtcatagctcaggcaggagtatggtagcttggacttggcaacagcgtgcaggtagagcaccaccgctggagtctggatgcgggatgcattctgatgtagggagtgggggaccgcgcagcatcaagaagccaccgctggagtccagatgagggatgcgttctgatgtagggagtgggggacggcgcagcatcaagacttgcactgaaaatttctgctttgagcaactgcgtggaatggatggaggtgtccttcaccagctatgggaaaggccagggaaaggtttaaagggctgagtgtggtggctcatgtcagtaatcccagcacttcgggagactgcggcaggaggatcacttgagttggagaccagcctgggcaacatagcaagacactctttagaaaaattaaagtagagaaaaagaaaggtttaaagggaagagactgagggttcagaattgtacctcatcagtttctgagattcctgtgagctctccaagtgcataaataaatgtgggaatcattaacaaataaatggtatgaaaaagcaaaggaatggatgagaccacccaggaaaagtgtacagagagagaagagaaataaagaggagagagttaaagagaccagaataggccaggcatggtggctaatgcctgtaattccagcactttgggagccaaggggcgagtggatcacctgaggtcaagagttggataccagcctcgccaacatggtgaaaacctgtctctactaaaaatgcaaaaatcagctgggtgtggtggcacatgcctataattccaactactcgcgaggctgatgcaagagaattgcctgaacccgggtggcggaggttgcactgagctgagatcgcaccattgtactccagcctgggcaacaagagcaaaactccatctcgaaaaaatacaaaaataaaaaaataaagagaccagaatagaagagagcccaggactgagtcctgaggaaacagcacagagatcagagagaggagaagactctgaaatagggaaactggaagaaatggccagagacaggagaaaaccaagagggtcaatgtcactgtggctgagagagaatatttccagaggatgaatttgctcagccagccaagtgcttctcacagggtcgctccatacagaggccattgatttcatgggcacatggagctgattcaagaacgagtgagaggaagtgacagcgtgtgcaagaagacagcttgtagagggctggctagcttctcctcactttgtagccacatctgctatgaacttatcccatctcttcttccagatttccatgaaagtatttttctcactctccaacagggtactgtacctgcaggaagaggaggagcccaggtcagcctcagggcaggggttggggaacggggcagggagcctgagaggacattagagccttgcagagcactctccccaggccagcagcaaggactaaacagccatgatgagaaggaacccacaggaaccatcgaggcatctgcctcaagcctccagagaggcaaacacaagctgcgggctggaaggaggcgggggacctgggaggacacaggacactcacttgatagagttcatggccagctgtttgagggtcctcaggtcagccttcatccccccaatgcccatgaagacctcatagaaatcataggacaagcctttggcaccaaacatagctgggtcatcagagctgatcaccatggggtgcccagtggccatcagagtggctacagggtggttcctcaagtcagacaccagtttcagcacctgcgcaataggagggaagggagaaagatgaactctgatccctaaaaagagtagtcacaagtgaggtgagaccttgagccccatcagctcccttcatcttcccatcactatctccccagtatggggatgacttctgggcagagtcacaaggagacataaggaacagagccagtccttatgctcctcctcatgtttcatcagcactgcaaacatcgggtcacttctgttcctgctcagagaagcgctaactgaacacagacacaaaggaccccaagaaaccatggggagcagcatcccatggtccgtcccacttcactggcctccccccatgtcctttttgctttgtctacagtcttgcccaaaattccaccccactggggaccctcactgctgcctcattcttattggtggcttaggcaaaaggcccctcctgaataactttactaacaggggtaggagagtggagggatgtaggtaacaagagagttaaggagagataagttatacagcaaaaagtttaagagagcagaggttgtggttaggggagatcatatgggattagccacatgggtcacacatacctggttagagatgggacagacttctatggggatgtcctttttccaggagtaagtcctgactgcggggtgtttgctcaaagcaaatccatggccgattctggtagtgttcagcatcagagcatccagaatgttcctgtctatggaagtaccctgccagtctgaacacacgggaatggtcttccatgggggatggatgggtctggtcttccatgggggatggatgggtctgacccacccgccccccgaccatcctcaaataaacagccccccaagcacaaaaatgaagagaaattaacattaacacaaatacacacacacagtttccttttaacaatgctaaagagaggtatgatatggctttattaaattaatcatctaatttattaatttatcattctaatgagaaagttgaaacttaatagcttctataaattgaccaaggatgttcacacagtaagtagcaaaaccgagttttttgttgttgttgttgttgttttttgagacacagtcttgctctgtcgccaggctggagtacagtggcacgatctcagctcactgcaacctccacctcccaggttcaaacaattttcctgcctcagcctcctgagtagctgggactacgggcacacgccaccacgcccagataattttttgtatttttagtagagacagggtttcaccatgttggccaggatggtcttgatttcttgacctcgtgatccacctgcctcagcctcccaaagtgctgggattacaggcgtgagccgccgcacctggcctgcaaaactgagttttaaaccttcgtctctctgaccccacagtccgctttccttcttcctcttttgtggcactcttttttttttttttttttttttgagacggagtcttgctctgtcgcccaggctggaatgcagtggcgtaatcttggctcactgcaacctccgcctcccgggttcaagcggattctcctgcctcagcctcctgagtagctgggattacaggtgcccaccaccatgcccggctattttttgtatttttagtagagacggggtttcaccatgtcggccaggccggtctcaaactcctgacctcaggggatccacccgcctaggcctcccaaagtgctgtgattataggcatgagccaccgcaccgggctctgggactcttatgcttatgatctttacaacaatatgttacaggttctcttattgacaacatcagtataactacctgtatgtgctcactttaatttatatatttaatagtactgtcaagatgttatcactcgctagatgaccgcagacagtcttgtggcctcccttctcccctgccatccccatcacacctttctttttttttttttttttttttgagatggagtctcgctctgtcacccaggctggagtgcagtggtgcagtctcggctcactgcaagctccacttcccggggttcatgccattctcctgcctcagcctcccaagtagctgggactacaggcgcccgccaccacacccagctgatttttttttttgtatttttagtagagacagggtttcactgtgttagccaggatggtctcgatcacctgaccttgtgatccacctgcctcagcctcccaaagtgctgggattacaggcgtgagccaccacgcccggccccatcacacctttcttgcagctagggccctcggtagaggatgaaaggtcagatgtgcctttctcagtctcccttacagctaaaatagccttaacgctggactgggaggttatttgttggggagctttgggggattcctccctgataaaaggggatccactgggaggctgtctcctattttgcttcactggatgtggtcaccccaaatgtgattcaccatccgacaaccaagtggggcagaatcacccacacaatgggcatagcacagattgcttcttacgtgagataacaaatgtccttattgtaaaatcggtgggatgcatgtactctattcttgcagccataagcattctaatggattcacatataaaatatgaacatctggctgggtgcggtggctcacacctgtaatcgcagcactttgggaggctgaggcaggaggattgcttgagcccaggagttcaaggccagccatgggcaacatagagacaccctgtctctacaaaaaatacaaaaattagccaggcatggtggcatgtggctgcagtcccagctacttaggaggctgaggtggaaggataacctgaacccaggaggtggaggctgtagtgagctgtgatcacgccaccacactctagcctgggtgacagaggtggaggctgtagtgagctgtcatcacaccaccgcactctagcctgggtgacagagtgcccatgtcaaaatatatatatatatatatatatatgaaaactccactttcctgatagaaataaaactcaagaatttccattgctatgtagcacatgtgttttggtggattttcactggtttttaaagatttctttttctttttaaaaataaggatattggccgggtgtggtggctcacacctgtaatcccaccactttgggaggccgaggtgggcggatcacgaggttaggagttccggaccagcatgaccaacatggtgaaaccccgtctctactaaaaatacaaaaaatattagccgggcgtggtggcaggcgcccgagtagtcccagctactcgggaggctgaggcaggagaatggcgtgaacctgggaggcggagcttgcagtgagttgagatcgtgccactgcactccagcctggggacagagcgagactccgtctcaaaaaataaaataaaataaaataaaataaaataaaaaaataaaaataaggacattacttttaggtattagatacccaagtcctggcaaaatcatctccaaggaccatacatcttggaacctgttaggtcctgagctgcaatgttttgtagggccagaattatttcacacacataagtatgattttccccaaccagaccacaagctcttcaaggttaacaacaccctcgcccaaccccctccccctcaaacaattcttctgctctcctagagcagactttgatctaaattggatctaaattgactcgaaatgtcaggaaaaagagattaatgcacaaggtccctttctctgagagaaggtgtgatagagcagagcttaagcctgggtgggaaatgaaattgcccaccactctctccacccctctttggtcttccgagggtgacaggtgggatgctgaagagagctgccctcctggtcccggcctccatgtgaacagcctcctcccaaatcttcctttggatctgaaattgcagccgtgatctttcttagttagggtttacacattttaaggactggaatacgggaggggctgagatgactgagcgagcccaaggatggagttctgggaaagaaagatgtggctgggctgatggcgtttcaggaggaacagcagccagggcctgcatggggcagggcagggtttcctctcctacgataatgcgggacagaacatcctaaagacaaggagcagacctggttctcctccctcttctgccaatttccagctgtgtggctttaggcagatcagttaacctctcaagcacaattcactcggaggatggagagcgtcagaaagtgttccaattcatacacattatatacaggcatcaaaatatcacatgaggccgggtaatcccagcactttgggaggccaaggcgggtggattgtttgaggttgggagttcaagaccagcctgggccaacatggtgaaaccctatccctattaaaaatacaaaaattagccgggtgtgttggtgggcgcctgtaatcccagctactcgggaggctgaggcacgagaatcacttgaacctggcagccagaggttgcagtgagccgagatcgcaccactgcactccagcctgggcgatacagtaagactctgtctcaaaagaatttttttccgtggctcaagcctgtaatcccagcattttgggaggctgaggtgggtggatcacttgaggtcaggagttcaagaccagcctaaccaacatggtgaaaccccatctctactaaaaatacaaaaattagctaggcatggtggtgcatgcccgtaatcccagcttctccagaggctgaggcagaagaatcacttgaacccgggaggcagaggttgcagtgagccaagatcgcaccactgcactccagcctgggtgacagagtgagactccatctcaaaaaacaaaaaaattgaccaggtgcagtggctcacacctgtaatcccagcactttgggaggcctagacgggtggatcacaaggtcaggcgatcgagaccatcctggctaacacagtgaaacctcgtctctactaaaaatacaaaaaattagccgggcgtggtggcgggcacctgtagtcccagctacttgggaggctgaggcaggagaatggcatgaacccaggaagccgagcttgcaagtgagccgagatcataccactgcactccagcctgggccacagagcgagactccatctcaaaaaaaaaaaaaaaaaatttgttttcctttttgtgtagaatggaatcttactatgttgcccagactggtctcaaactcctgggctcaagtgatcctcctgcctctgcctccctaagtgctagaattacagatgtgagccactgtacctggctaaaacacttttttttttgagacagggtctagctctgtcacccaggctggagttcagtgagcctgggctcaggcaatcctcccacctcagcctctaagtaggtgggaccacaggtgtgtaccatcatgcctggctaatttttgtatttttttgtagagacaaagttttgccatgttgccctggctggcctcaaactcctgggtttaaagagatccacccacatcagcctccaaagtgctaggattacaggcatgagccactgtgcctgtgcccagcctaaaacgaatttttatagccaaagtaggatgatgtgagtttgcaggattatgcccctaccacgaaaaattaaaaaaaaaaaaaaaaagaagaagaagaaggattcaaattcagactccactgcgcaccagctctttaaccctggaccactgtgtttggagccttgggctcttcatctatcaaatggagattaaaaactggggaaacaatcagaaatcaattagaaaaggccaggcgcagtggctcacccttgtaattccagcactttgggaggccgaggagggcagatcatgaggtcaggagatcaagaccatcctggctaacacggtgaaaccccgtctctactaaaaatacaaaaaattagccaggcgtggtggcaggtgcctgtagtaccagctacttggaaggctgaggcaggagactctcttgaacctgggaagccgaggttgcagtgagctgggcgacagagggagactccgtaaaaaaaagaaaaaaaaagaagaagaagaaaagaaaacaggaaggaaagaagaaagagaaactagaaataatacatgtaaagtggctgattctattatccttgttattccttctccatggggctgttgtcaggattaagtgagatagagcacaggaaagggctctggaaacgcctgtaggctctaaccctgaggcatgggcctgtggccaggagctctcccattgaccacctccgctgcctctgctcgcatcccgcaggctcacctgtttctccggcgtggaagaagtaaggcagcttaacgccatccttggcggggatcatcagagcttccttgtagtcatgcaaggagtggccagtgtcctcatgccccacctgcaggacagagagggacagggaggtgtctgcagggcgcatgcctcacttgctgatggcgcgccctggagcctgtgcacacccttccttgtaccctgccaccactgccgggacctttgtcacacagccttttaagaatgaccaggagcaggccaggcgtggtggctcacacctgtaatcccagcactttgggaggccgaggcaggcagatcacgaagtcaggagatcgagaccatcctggctaacacagtgaaaccccatctctactaaaaatacaaaaaattatccaggtgtggtagcgggtgcctgtagtcccagctacttgggaggctgaggcaggagaatggcatgaacccaggaggcagaacttgcagtgagctgagatcacaccaatgcactacagcctggccaagagcaaaaaatatatatatatatatattttgtaaagacggggtctcaccgatttgctcaggctggtctagaactcctggactcaggtgaccctcccaccttggccccccaaggtgctgggattacaggagtgagccactgccctggactaatctagattcttttttttttttttttttgagatggagtcttgctctgtcgcccaggctggagtgcaatggtgcaatctcagctcactgcaacctctgcctcctgagttcaagtgattctgcctcagcctcccaagtagctgggattacaggtgcaggccaccaaggctggctaatttttgtgtttttagtagagatgcggtttctccatgttggccaggctggtcttgaacttcagacctcaggtgatccacctgtctcgccctcccaaagtgctgagggcatgagccactgcacccggcctagattctttatgagattgccgagctgtcacctaagaaatgtcctggttgtgcttcgatttggtggggaggtgtgggacaatgacaacacctatgaatgtgtagcttcaaaaactggtgtggccaggcatgatggctggagagggagggacaaatatcactaccttgaggatttgcaaaggcctggctccatcctggactctgtttccagacattaccccccagtccccaccccgcgtgctacaggggctggtgagggttttaagacccacacctaggtgagcagtgtgggatagaaaaaagggcacaggcagggccatggggaatgagcccataactgtggtccaaactccctgaatgccatccttattctggaactttccttgttagcttgttagaactggctgtctgctctcccttctccagtgacagccgtcccctgtaggcctctgaagagggtcagcgctgagctctgagcagccctgctgtgtcagcagcctgagcctgccctgggatgtcagggtaccaacaggcacattgcgctcccttcccagggagttgccgctccacccagacaggcatcctcgcatgcccccttaacaggcagcccttctgttcacagcatgggttaccaggtcaaaccctgccaccaccgtggggaacttgattcggagccccatggccattcggatggattctgcgatgacagccacatctttggatctgtgagacagacagagaagccaggagacagtgcccagcaccgacagagcacaaaccccagagcacaccctccgtgcagggctgggccagccccaagtgtgcaggtcccgtttcccaaacctgaggcacccctgccctcctgaccccaccctgaccaggccattgtgatccctgagagatatgtagcccaaatccattcttatcaaagacccttgctggctctgggggcacctgtagtctctgaaaagtagatggggtcagaggacccacgggaacagttttatttgtctgcgtttagaggaggccaggtggccttgttcccagctctccctgcatctctgtcgggggtgtagacatggatgcagctcaggggcagctctctgtccactgcacacctgcaaagggccacaggtcacccaagtccctgatgggtcggctggacccagtaaccatatggcctcttgctgattaagtcagcaagatcctgggtactgcagaaccctacaggggcaaggcaggcagcatgacaacaaaagccccaaaacacagggtctggcgcaagcccacgacaggctcaaggtctttgccctgccactggctctcctgctccaatcctcggctctgtggggataaagccttcctggcctgccccacccatggcctctccccagagcctaggcaaacctgggggcactgatgcactcagctcagccctcacaccctcctgccactggccctgggaaggggcacctggcaccagggagcctctgagcagaacgtgggcccatcctgcaagctccctcctagggggaccggcacaaagccagagcttagctcctccaggccccaggccccatggaagggaaggggactcaggaagactgggcatgggaggaggctcctggggagtcagtgccctccagagcccaggctcgtgggtgagctgagcagagggagccgctgccggatcccttcggtgcccgccccgtgcctgactccgagggaccccactggctgctgcccttgcagctgcgaccatggacaggtcccagccttagactggctgctctttaaagtgaggggaggggtcttgtctggtaaagtcagaaggacaattaagctgcaaagctttctgtgcttccctgggaaaaagagtgggtctttcacccacgtgccaggccacgcacatggtactactggaggtccccacacgcagacttgagccagtgccactcagggtgtctccgtgatcaaggactcacacacaaccacacacagaacccagaggcaaattgaaaccaaaaacgggccaattatccaaacattcaggcaaaaccattatgctcataaatgagtcaccaggccaatgtggggtcacagccgagaattatctgggaaattcacacattcttcatttcagtttgggggtgaagacctgaactagaagtggcttcaggcagcaattcattgttgggtcaccgcacttacctaggactgtgctctcacacaggcacagcacagctccttggcaccagtgctgggcctctcccggcctcccagccccgcttctcacccctcccctcccagcctagtagctctgcctgcatcccagcctcccaacccgagcttttcagcaatattctctctcacctgtgatccgaataaatgattttgattccaataaactcagggtgagtttccacaaacttctgagctacttcctggtaagtcttcactgaccactcttcgtcatggtgctctccactgagctcatacacctgggaagaaagcacaaccaggagccgtcaggtgagcagtgagagacgccacccccttcccagccacccctgcccagccacccctggccagccacccctgcccaaccacccccttcccagccaccccttcccagccacccttgcccagccacccctgcccagccacccttgcccagccacctccttcccagtcaactccttcccagccatcaacgagctctgggaaaagtagatggggtcaggggacccacaaaacagttttatttgtgtttggattaggccaagtggccttgttcccaaaagtccagccaggctggacttgtgcttcccttgttcaggtcctctacggccttgggcattgtctctgctgctgcatggggaattcctagctggctctgggataaccctgatgctgatgcccacctgtctccttcattgctgggtcactgcacttaaaacagcacatggcacacgcgagggtaggtgcccattaagcatctgcataatggttgaagagcaggtcacggggggagaggatgaaagctagaaagagtgatctgagaatgacgtcattccccactacctgctcacctccccactgcttccctaactccaggtgcagcagctgcaaggcggccactgccaccagggacagcaagggggacacagtgagagcagagtggggagagttgggagtgggcaggtgacaaggaagctaagggaagggaggtgtgtaatggggaaaggtggctcacacctgtaatcatagcactttgggaggccgaggcagggggatcacttgaggtcaggagttcaagaccagcctggccaacatggtgaaacccccatctctaccaaaaatacaagattagctgggcatggtggcacatgcctgttaatctcagctactggggaggctgaggcaggagaatcgcttgaacccgggaggcagaggttgcagtgagccaagatcataccactgcactccagcctgggcgacaaagcaagactctgtctcgaaaaaaaaaaagggggggccctctctcttcctcggcgctgcctacagaagtggcagccatctcctctttggcatcatggccaccctcagaccccttgtgaagcctgattgtcaaaaagagaaccaaaaagttcatctggcaccggtctgaccaatacgtcaaaattaaccgtaactggcggaaacccagaggtattcacaacggggttcatagaaggttcaagggccagatctcgatgcccaacagtggttatgggagcaacaaaaaaaaacaaagaacacgctgcccagtggcttccagaagttcctggtccacaacatcaaggagctggaagtgctgctgatgtgcaacaatctccctgtgctgacatcgctcacaacgtttcctctaagaaccacgaagccatcgtggaaagagctgcccagctggtcatcagagtcaccaaccccaatgccaggctgcgcagcaaagaaaatgagtagacagctcatgtcccctttttgtgtttaaataaaaccgtaaaaactgcaaaaaaaaaaaaaaaaaaaaaaaaaaaggacagcgcggtggctcacgcctgtaatcccagcactttgggcggtcgaggtgggtggatcacgaggtcatgagttcgagaccagcctggccaatatggtgaaacctcgtctctactaaaaatacaaaaattagccgggtgtggtggtgcgtgcctgtagtagtcccagccactcgggaggctgaggcaggataatcgcttgaacccaggaggcagaggttgctgtgagccaagatcgcgccattgcactccagcctgggtgacagagcgagactccaccttaaaaaaaaactaaaaaaaaaaaaaaaagatgtgggaatttctgcagagactgtggggtgaaggagacagggagcaataatatggagatgtcgattacttccatggcatcagttaagcccttatgatataaaaggaacagggctgggcattggaagggatgaaaaaatgctaatagacaagatagctgccctcaggagtgacaatagggtcagagagatagacctgacccactaaaaagagctcacgcctgtaatcccagcactttgggaggccgaggcaggaggatcacttgagcccaggaggtcaagaccagcctgggcaatgagtgagttcctgtctgtaaaaaggaatgaaaaaaaaaaaaaaaagaaacaatagaataagtgctaaagagaagcacatgacctctcaaaagaagaagcagtttgttgtgactggatgggtcagagaaggttgctagtcctgaccaagggaatggtggctccacacagagtcaagagctgcctgggggcgggggttcaaggagccgaggttgagagctgcagtgggagccaggagctgtcccctcactaagggagaaatgcccttcctcctcccgggagtcggctcttgcctctgtggcatctcaggaaatgggcccttgggagtccacctcctctgctcatttcccaccagccccttgcctcactcctgtctccccagcctaggggcctcccacacccctccaggctgcggccattgtgtgtcctttgtctctgggcagtccctcagatccccgcattcccccaggcctgcagaacagtactgctgctctctcatctccagggtgctgccccgctgcctgggcaggcgcagtgggggagcaggcagtgaggctctccactggtctttgctcttctgtttcctctgctgcccccatgaagcctggcacgtcacacagccccccacaacctgcacctggccaggccactcactctgctcgggcagtttccctgactgcctgacctggcacagccatgctcaggggctactgaactttaaggctgccagagcgtgccagaaggaagaaccttaggtactgttcattcaggatctagtattgtctattattattattatttactgaagagggtcagaatatgtcacccaataggccactttagcagaagaaatatttttagctgaaggcaattaagaagcagcaaatgaagaaagagctctttgcccacctcatctgcctaaatttccctttgtgaaggtgtcgccctcccctctcccgtaccaggagaatcacccttaccaccggaaacagaaagttgttaccaagatgggtctgcacaaaccagccttataaaattgcccttatcttccattagtttcccccatatgtttgcctgcccacaatttactgtccctagaagcccaaaccccttttccttcatcttgtcacttcttcacaatttattaccagttgttaaaatggaatataagccctcactctaacttctttggtgcttcacgtcttttcaaggaaggcctgcatctatctgtgcacatagcaaattcttaggccgggtgtgatggctcatgcctgtaatcccagcactttgggaggcggaggcagatcacctcgggcaaatcacctgaggtcaggagttggagactatcctggccaacatggtgaaacctcatctctactaaaaatacaacaattagccgggcgtggtggtgggcgcctgtaatcccagctactggggaggctgaggcaggagaatcgcttgaacccgggagttggaggttgcagtgagctgagatcgcgccactgcactccagcctgggcgacagagcaagactccgtctcaaaaaaaaacaaaacaaaacaaaaaaatttttttaaacttttattttgcaacagtcttgccgtgtcgtccaggctggagtgtggtggtgcaatcttggttcactgtctgtttcactcttattctctcatggatgtacagtagaattttcctgaagctgcatcatgtgtcatatcattctgaccgataatgccaatcatggattatgtgtttgtatttagaataatttctttcctttttttttttttttttgagacggagtctcgctctgtcacccaggctggagtgcagtggtgcgatctcggctcactttaacctccacctcctgggttcaagcacgactcccgagtagctgggattacaggcacatgccaccacgcctggctatttttttgtatttctggtagagacggggtttcgccatgctggtcaggctggtcttgaactcctgacctcatgatctgctcgcctcagcctcccaaagcgctgggattacaggcatgagccactgcgcccggcaagaaaatttcttaattttggctgggtgcaatagctcacacctgtaatcccagcactttggggggccaaggcgagtggatcacctgatgtcagttgaccagcctggccaacatggtgaaaccccttctctactaaaaatacaaaaatttgctgtaatcccagctactcgggaggctgatgcaggagaatcacttgaacccaggaagcggaggttgcagtgagccaagattgtgtgccattgtactccagcctaggcaacaaaagtgaaactccatcccaaaaaaaaaaaaaaaaaggaaaatttcttaattttaacatctaatacaggatatatcaatagatataatccacataaataaaaggcgtttgaaattaacaaaaatttttaagaatataaagaggttctgggaccagaaagttggagaaccactgtgttaacccaacccacaattgttacctgcagttgtcttggactcatccagctggttcacagcagggaagaatagggttctgtcctgaccttgaccaccctgtcattactgagtctcctgcccacaccccccagctagattggaggctcctccagggtagagtccttgcagttttactctccccacctcctctcctatggcaccagagcaggagctccataaataaatattaattcaaggagagtgctgtccacaggagttttaaaagtactaaggcccaggcagcaagggcaaatagacagttgttggcggagtggtaggtggagtcatgccagcagaatagaagggagaccaaagaaataacctttaaaaaatattaacaaatgacaactctgcttaaaagaagatctctgaggcctggcatggtggcttatgcctgtaatcccagcactttaggaggccgaggcaggcgaatcacctgaggtcaggagttcaagagcagcctggccaacatggcgaaaccccgtctctactaaaaatacaaaaattagccgggcatggtgatgggcacctgtaatcccaactactcgggaggctgaggcaggagaatcacttgaacccaggaggcagaggttgcagtgagccaagatcgcaccactgcactccagcctggacgacagattggttcatggggaaatttgggagcagagtgctgtaaaggtcatacaactggtttgtatcagaacagaaacaaggactcgcaatttctttttttctttctttcttttttttcttttttttttttgtctgagacagggtctcactctgcggcccaggctgcagtgcagtggcatgatcttgaacagccttgaatttccaggctcaggtgatcctcccacctcagcctcttgagtaactgggaccacaggtgcataccaccatacctggctaattattttgttttgtcctgttttgtagagacaagggttttgccatgttgcctaggctggtctcgaactcctgagctcaagggattcacctgccaccatctcccaaagtgctgggactacaggcatgagccactgcacctggccagtactggcagtttcactcagctttcactaccagagtatcattcacttaagaagtgttgagcttctactacatgccaggcatatgcagggggctttatgccataatctcatttaaccctcaaaactacactatgaggtaggtctcattttacagataaggattttgaggctttaaaagtttgagaaggctgagcacggtggctcacgcctataatcctagcactttgggaggccaaggcgggcggatcacctgaggtcacgaattcgagaccagcctgaccaacatggagaaaccccgtctctactaaaaatagaaaattagccgggtgtggtggcacatgcctgtattcccagctactcgggaggctgaggcaggagaatcgcttgaacccgggaggcggaggttgcggtgagccaagattgcaccattgcactccagtctgggcaacaagaacgaaactccgtctcaaaaaaaaaaaaaacaaaaaaattgagaaactcagtacccctgcataattagtggggctggaggccgaccacatttcagaattttgcttgccctgagttgtctcctgtcatcaggaggcccctgccccctcctgtagaaaggtgacagtcactagagtgacatctcagccctggcggcacattggcatcactcaaggagaggaaaaatgcctgtgtcccaccccagagcaaccaaatcagaatctgtggggtagaagcttggtgtttgtaatctcccaggtggtgctagggtgcgatatacagctgggctgaagatctgccactgttccaatcgacagacaagtaaatagcacaatgacagcatagtcggatgagtcctgtcaaaaagggagcagttaagagggtgcgtgttctcgtaaagcgacaccagcaacatgacacagggttcgcttcattcagcaaggagccaaatggaattttgaatgaaaggtctgctaagaatccaggcaaaagcatgggggctggggagcgcgggtacagggagcactagaaatgcttactgtatgaacgacaacgtcttagaaaacgtctgggaacgactgtcacaggttctctgccaccgacgtgtctcccataagctctcccctccataagtgccagcagggccatcccctgtggataaccctccggggtcttggaagagccccatgctaaagactcaggggacccagtctgggcctcagactctgccgtgggggaaggggccggagcccaggagataagacccgcctagcgaccgttgctaccggcgagcagcctttgttactgagcattaggaacacaatgggaggctcagcggccaggatagtccgtccacagcagcccaggccggaattagcctgcgaccaggcagggggaggcgagggggctcagcaaaaggattctagtgaagactgtttttagttgttaatgtgttggtggccccccaactctggctaatggggggcattaagacctagactctccgtggcaaaagcctttgttccagggtcagacccgaacaaatgggcacatcccctccccctccccctccaccagaatcccaaatcctagcagcccagcaccttctccaaaggttggctgggggacgggcggagacgggcagagtgaggacagaggactggagctgggcaggcccccaagtctctccacctccggctctggaaggagaaaatggccacctgcagaacaagggggaagatggaacaggaagccagtgctctggcccttctcttcctccctccgatccaaccgctcagcaacttctcccacatgcctccccaccaggctcaagatgaaagcctctgtctcagcgtctcctccctcccctcctctatcctcttcccctccacccacgaagatcccagggttctgcgagggtcggagttccctatgcactcccacaccaagacagttgtcaggatttgcccaacaggaagttctcccctaccagagcccagttccattccagggaatccatctcccctccggaaaaaggaaaattgaagccagatgctctctgggatcgccatttgaggtgggcgtggctattaggacgctcagagagcccagcgcggtgaggaaagcgacgaacttaggagccctggtctgggtccagccaccccttactacctatttgaccttcatcaagctctttgacctttccaggctttagtttcgacatcaataagatgaattaatagctgggcatggctcgcgtctgtaatcctagtactttgggaggccgacgtgggtgtatttgcctgagctcaggagttccagaccagcctgggcaatatggtaaaaccccatctcgccaggcgcggtggctcacgcctgtaatcccagcactttgggatgccaaggtgggtggatcacttgaggtcgtgagttcgaaaccagcctggccaatatggtgaaatctcatctcttctaaaaatacaaaaattagctgagtgcggtggtgtacacctgtaatcccagctactcgggaggctgaggcaggagaatcacttgaatccgggaggcggaggttacaatgcgccaagatcacgccactttactccagcctgggcaacacagaatgtctcaaaaacaacaaacaaacaaacacaagaatcacctgctctgggaagtgcagtttcttccagcctacctaggccaggagcaaagtcagctcatcaatttttgccagcgcctcccttttcagaaattcttttctcaataaaagatgagaccctctcttttcttttaaaaggatgatttgtgtcctgtgtcttgtctgtctgctctgtccacaaaactgatgaaagctccactgcaaggcaaagttaatgttcccctcccacttctcaagaactcagaaatggaaatataactctgcactcagagagttaaaatagaaaacaagcaacagatccaagtggagacatgcagatcacacaagagatcggactctccaggatccagccttgccgctaaactcaccaagggtattaacatatctaaggaaaaggccgggcatggtggctcgtaatctttgggaggccgaggtgggtggatcacctgaggtcaggagtgcaagaccagcctagccaacatggtaaaaccctgtctctactaataatacaaaaattagctgggtgtggtggtgcacgcctgtaatcccagctattccagaggctgaggcaggaggttcccttgaacccaggaggcggaggttgcagtaaaccaagatggtgccattgcactccagcctgggcaacaagagcgaaactctgcctcaaaaaaaaaaaaaacatatctaaggaaaaaggtgggtcagtccaggatgccaagcaaagggagagttgagacccacaaactggaataacttgaataacgagtggatcagctgaggtcaggagttcaagactaacctggccaacatggtgaaaccccatttactgaaaatacaaaaaattagccaggcatggtggtgtgcatctgtagtcccagctactcgggaggctgaggcacgagaatcgcttgaacctgggaggtggaggttgcagtgaggcaagatcataccactacactccagcctgggcgacagaaattctgtcaaaaaaaaaaaagaagaagaagaaagaaaagaaaagaggagaatttcctgatgaagcataagtgtctggtccgaatgataacagcattctgactttcttgtttacacatctatcccttatgaatttgttcagtgtgtattgatcctgcggagtcctatcacttctgggtctacaaacagtaaacttcggagcgtataaaagcctacagaatatgctaacaaaactaaaatactgccaccatgtgggcctttccacaagcttaactgtcagtccccaaggcatttgtgtatccgatcaatatgtaaatgaacgagcagactctcttggatacaatgtggagaagactctaccaaaggtcactttccccaagccactgataacctttaaccagctcaaacccgtctgagctcaccacataaaacacccaaggatcctgcccactcccacaataccccatctccctcagcccaacaaaaacatcctcaggaaagttctctccaataaactcactgaaataaaactctagcagtatttgagcacctagggctgctctcctcgaaagatccctcccctaccaacacggagcctggtgtcagtccatctcagagtacctaacctcagttatcctttgcttctggccaaaatgcaagacccaaaaatcagatttttttgatgatgctcccttcttttggactctttctactcctttccatttcactctctccaaacttccttccttaaaatcaaatttttttttcttttttcttttttttttttttttttttttgagacggagtctcgctctgtcatccaggctgaagagcaatggcggtatctctgctcactgcaagctcctccccctgggttcaagtgattctcccgcctcagcctcccgagtagctgattacaggtgcgcaccaccatgccagctaattttttttttttttgagacagtctcactctgtcactcaggctagagtgcaatgacacaatctctgctcactgcaacctccacctcccaggttcaagcaattctcctgcctcagcctcccaagtagctagaagtacaggcatgcgccatcgcgcccagctaatttttgtatttttagtagagacagggtttcaccatgttggccaggatggtctcgatctcgacctcgtgatccgcctgcctcagcctcccgagtgctgagattacaggcatgagccacctcgcccggccaacagctaatttttgtatttttagtagagatggaatttcgccatgttgaccaggctggtttcaaactcctggcctcaagtgatccaccagccttagcctcccaaagtgctgggattataggcatgagccaatgcacctggcctcccctctctttttaacctctccacacttcttccttctgtgtgcaaaacaagtctctccatcctaaaaagaaacctgtggcccctgtggttccctccagctatctcgatgttctttttctcaaatcacactcagagcctttaatcagccaaacctggctccaattcatcacctgtatttcatttttctttctcttttcctttctttctttttttttttgtgtgtgtgtgttttttgagacaacatctaactctgtcacccaggctggagtgcagtggtgcgatcttggctcagtgcaatctctgcttcccaggttcaagtgttctcctgcctcagcctcccgagtagctgggactacaggctcatgcccggctaattttttgtatttttagtagagacagtgtttcaccatattggccaggctggtctcaaactcttgaccttgtgatctgcctgcctcggcctcccaaagtgctgggattacaggtgtgagccaccatgcccggccgtctatttcatttttctactcccagaaatggggtttctcttctcagcatgttactgaaactgctcaaaggtgaccttgtaatttccaaatcccatggacgattatgcatctgcatgtctcttgccctcaccctgccatgtggctccttttatttttcaaaccccttgttttggcccctaagatggctctatcccaattctccttctcagcttatgtcacgaggccctgagtatcatggcagaggggagaacggggaaccatgagaaacaggggggcaaagggcagcacggaatgtgttcccagttttgctggaggctgcccagtccatttcaggtttccttgctcatgttggcccctggaaaggcacatgatcccttgcaccagagacctgagtggtcaattcatgagcattcagtcttctaccagctaagatctgagtcaggccagagcaaaggaggtgggaggaacagagaggagagctgggctcaccggcagcagcctggctctgatctccatgtagagcacgttgtcctcgtagaactcctgcatgctccggaagacatagtctctgaacactggtgcgtaatggatgagaccagagatggtgaagaagatggtttcaaatttcgaccagacaacattttggtttgtgtaaatcacctccgggtgctgggtcaccagagtgaaattcctcagcaagctgtccaagacacgaagtggggagtggcagaggcatgatccaggacactgcccccgggcgcccataggactgctacccaccttgcatatcccagctagcagctcacaggattcaccctagagtggagataaggaaggggcaaaggggagcattcccacgctcacgatataagcatgggtcctgtggccaggcagcccactgcctgcttaaacccaaaccccaaacgcaggagactgcttaagatgagagctcaccagtcagtctctcctggctcctgtcctccctctgtatgcttggccagtctgaccccactgtactttctagaccaaaaagctctctctctctctctttttttcttcctatacccactgacaggaaactagaccaagctctttttggggaatgttatggactaacttgtgtccccaaacccccaaattcaaatattgaagccctagccctcatttggagaagggaattttaaagagatgattaagactaaatgaggttgtaaggatggggctctaccctaataagatgggtgtccttgtaagaagaggaggccaggcgtggtggctcacgcctgtaatcccaacactttgggaggccaagatgggtggatcatttgaggtcaggagttcgagatcagcctggccaacatagtgaaaccccatctctactaaaatacaaaaatcagccaggcgtggtggtttgtccctgtaatcccagttactagggaggcaagagaattgtttgaaccctggaagtggaggttgtagtgagctgagatcgcaccactgtactccagcctgggcgacacagcaagactcatctcaaaaaaaaaaaaagaagaagaagaagagaccgcaggagtgcacatacagaggaaaggccatgtgagtacacagccagaggcgccttctgcacgccaaggacagaggtctcaggaggaaccacccctgccctggcaccttgatcttagacttccagcctccagaaccatgagaaaatcaattccttcttttttttttttttttttgaaacagggtctcactctgttgcccaggctggagtgcagtgtcacaatcacagctcgctgcagcctcaatctcccaggctcaagcaatcctcttatgtcagccccctggggtagctgagactataggtgtacaccaccacatctggttaattttttattttttgttgagatggggatctcactatgttgcccagactggtctttctttctttctttttttttttaaacagaatcttgctctgtcgcccaggctggagtgcagtagcatgatctcagctctctgcaacctccgcctcccaggttcaagtgattctcctgccttggcctcccgagtagctgggattacaggtggctgccagcatgcacggctaatttttttgtatttttagtagagacagggtttcaccatgttggcctggctggttttgaactcctgacctcaagtgatccgcccacctcggtctcccaaagtgttaggattacaagcatgagccaccacacccggccaccaggctggtcttgaactcctgggtgcaagtgatcctcccacctcagcctcccgaagtgctaggattacaggcatgacccagtgtgcccggcttgagaaaatcagttcctattgtttaagctccccagcctgtggtattctgttatggcagctcgagcaggttaatgaagggagtggaatggaaataactcgaatcagcacccaggtttgtatccccaactggccatttaccagctgtgtgtccttgcataagctaattaaccttgctcagcttcacgtttctcatttcataaagggaagtaacctcaggggggcactctgtagacatttctgtgaccaaattaattgtcacttataatattactatacaatgccaggcacaatggctcggctcatgcctgtagtcctagcactttgggaggccaaggtgagaggacggcttgagccgcagagttcaagaccagcctgggcaacacggcaaaaccccatctcacaaaaaatacaaaaattagctgggcatgatggtgcacacctctagtgtgctgacacaggaggattgcttcagctgacacaggaggctgacacaggaggattgcttcagcctgggaggttgagtctgaagtgagccgagattgtgccactgcactccagcctagatgatagaatgagaccctgtcttaaatagtaataataataatgatactatacaagtctgttaggaagttgctgcatcagattttcaagaagatttatcttccagctagattgtcatcacttcagagctaggaacttttattctctctggttttattgagcatcagacaaatctcatttgctacagcaatagtgttgctgactaggcatggtcactcatgcctgtaatctcagcactttgggaggccaagatgggcagatctcctgaggtcaggagttcaagaccagcctggccaacatggtgaaaccctgtctctactaaaaatacaaaaattagccaggcatggtggcacatgtctgtaatcccagctactcagaaagctgaggcaggaaaatcacttgaacccgggaggcagaggctgctgtgagccaagatcaggctgctgtgagccaagatcacgccactacactccaacctgggtgacagagcaagaccctgtctcaaataataataataataaataacaataataataacaaacaaaaatagtgttgctgataatgctttttgtagattttaaatgcaccagaaaaactactatggatagaaaaggtgttgaatgcttttgtggagcaaagtatcctgcaaggttaaaagaaaaaggtgctcatgctttttttttgagatagggttttattttgtcactcaggctggagtacagtggctccatctcagttcactgtggcctcaacctcctgggttaaagtgatcctcctgggttaaagtgatcctcctgcctcagcctcccaagtacctgggactacaggtgcagcaccacacctggctaattttttgtatttttggtagagatgggctttcaccatgttgaccagactggcaactcctgggctcaagtgatccgctcgccttggcctcccaaagtgctgggattataggcgtgaaccaccgcactcagccttgcctcatgttttattaaagccagatttttatctataggtttgtaccaagggagacacctacccactgccaccccatgacaggcctgggacatgtgctttctgaactactactcacctgtcatcaaactcagtgacgttctgcacccgcttccgataatcctccagcagaatccacttggaacatttttctgatggacggggagttgggtgagcaaatctgaactgcatgatcccccttggggtgaaacagatgtggcagtgaggcctgtaggtgacattcctcaccagccagtccatagtcacgatgccaatgtcatggaggtgcaaggcagcccctggagagggaagaagaatggtgaagacaaaggggtgaagtcccatcccaggactccagggcttggggacaaaggagggggtgaagtcccatcccaggactctggggctgtggggacaaaggggtgaagtcccatcccagggctccggggcttggggacaaaggggtgaagtcccatcccagggctccggggcttggggacagtgtggatcacaagaagacgtgcaagcagaaggatttctgtccagacatgtttctcggaacttgtttaaggctctagtttaaggatggggcttccatgtctcactaatcaggagccaggggtgatcttgtccaagaggggcagcatgggagagtgagagggcatcaggcttggaaccagagaactgaggttcaagtcagggctccattggcttctagctctccaatgggagcccaggcctttcaatgaggccacccaacactgcatgacgggatacactgggatgagccccagggccacggtccttttcacacacttgtcctccatcctctcatcctgcccctcaactcctctcccactggcttttcatcccctgcgctgggcctgtgtctgtacagcttctggcctgcaggctttgccagttgaatccccatgcttgtcctccccaccagacaccagctgtgccccttgctcccctaggcacagtgcatgctgtccctctgcgcttcttgtgcccatccagcccctggccctgacacgagcccccagacaccctcttatgcctcccagcaactggggatgctactttactgacctcacgattattattattttttaaatctctatttataacattaaaagaaaaaaaaacagctgggcacagtggctcactcctgtaaccccagcactttgggaggccgaggcaggcagatcacgaggtcaggagttcgagaccagcctgactaacatggtgaaaccccatctctactaaaaatacaaaaattagccaggcatggtggcatgtgcctgtaatcccagctactcgggaggctgaggcaggagaattgcttgaacctggaagaaggatgttgcagtgagctgagatcacgccaccgcactccagcctgggcgacagaacaagactccgtctcaaaaaaaaaaagaaaaaaaaagaaaaaaaaaaaacaggtgttaagtctttgtaaactgcaagctgctattatttttacattttaaattaacatttttggccaggtgcagtggctcacacctgtaatcccagcactttgggaggccgaggagtgtggattgcctgagctcaggtgttcgagatcagcctggccaacatggtgaaaccccgtctctactaaaagtacaaaaattatccaggtgtggtggttcatgcatgtaatcccagctactcaggaggctgaggcaggagaatcacttgaacctgggaggcagaggttgcagtgagccaagatcacaccagtgcacttcagcctgggcaacagagtgagactctgtctcaaaaaaaattttttttaataaaaaaaaaaattaacattttttggggaacagggtcttgctctgtcgcccaggctggagtgcagaggtgccatcatagctccctgcaaactccacctcctgggctcaagcgatactctccactcagcctccagagtagctcggattacaggtgcaccaccacccctggctatttatatgtgcgggatgctaattatttcatgtttcatggaggtgtgtttatactactccaggatgctatatcacattgtatcctatgtggtagcttagcccctgggaaaactaaaaagggaatagcaaagtctcagggctggatgcttttccaatcctgactgtctgcgagtcccccaggaagcaggggttttggttttcaacacccttttcctagtctacccataaggacagaggagcagaacagctgagtgaggctttctctgctccatctagaatagcaacagccacaagcacagtaatagccccaagatgagtccctctaccttcccagcaccccaagccacccctttccaaaccttaccttttggcatcatccttagaatattaaacacttgacttctctcaatgagatgcttggcctggaaaaagtgcatgctgggtgggaatatcagggtcctcatggcctccttcatctcagcgattttgagcgtcatgagcctctcattggccagctcctccttggtgttcagcaccagccgcccccccagccgcatcatcttttctttcaacaacagatgcgcccgtgtttcatctatggatagagctgagccgaagaaagacattgccacagccaacagcaagaagcacagggctggccgctcagatgggccatccaccaacatcgggatgcctggactaggaaagggctcagatggagactccacgggactgcaaaggagagtgggggagtgaaaacctacagatttaagggtggaactctgatcttccttttctcgccctgctctcagattaccagaaggcaagatattgaaggattcttcttccagaccccagagaaaagacctacaggtacagacaggtaggggtttcccaatttttttttttttttttttgagacggagtctcgctctgctgcccaggctggagcacggtggtgcaatctcggctcactgcgagctccgcctcctgggttcacaccattctcctgcctcagcctcccgagtagctgggactacaggtgcccgccaccatgcccggctaattttttgtatttttagtagagacggggtttcactgtgttagacaggatggtcacgatctcctgacctcgt

SEQ ID NO: 12761 - DNA, 335 bp, Homo sapiens
gtggtgtgatctcagttcactacaacctcctcttcctgggctcaagcaatcctcccacctcagccttctgaatagctaggaccacaggcacaccccaccatgcccagctaatttttgtatttttagtagagatgaggtctggccatgttgcccaagctggtctcaaactcctgggctcaagcaatccactcgcctcggcctctcaaagtgctgggatgacaggcgtgaccccctgtgcctggcctggtaagagttttttgtactattcttgcaactttttgaaattatttcaaaatgatcagataaatgctccatggacatttagttcaatagga

SEQ ID NO: 12762 - DNA, 12581 bp, Homo sapiens
tgaagaacaagcatgtaaccaccaaaacaatggcagatttaatttccatagaggttgtgaagctgatataactccagaagacttgtttaatatattttttgggggtggatttccttcaggtattttaatgtaattatagatattatattttatgaagctacatagtcttacctccagttaacgttatttagagatgtatctaccttttcccctacatttcttgtagtgttacgatcctgtaatggtttttcatgaaagcaggagaaaaatattagggttattacttttataatagcctgcctttttcctagaacatattttaatttaaaaaaatgaagagtacagatattctgtattttatataaagctgaaagggaatgtaagcaggaaatgtaatggcaatgtcttaggtaagtactattataattatgaatggttttctttacttaaacctggataactatttgacattgcttccctagagatctttgtaaatattttatcaataacattatagttggctaatttggatatatgtagaggtactcatctctatttccatttaaacagtagaaaatctgattcataggttatatacaaagtaagtggatttttaagtttacattaaaatagaaatagctaactttaactagactatcaaagtgaaatattgtagtgatactaagattttatagtaccaacataaatagtatcaaactccacttacatttacagtaagtggtcacttaacataaggtttttggaaactgtgactgtaagtgaaacaatgttctgtataacaactaattttaccgcaggctaattgatataaacaacagttaaattgctaaggcatatagtacatcatgtttacttgaagttgcagtttccaaggacctcttgatgacgttaagtgaggacttactgtactgtgagttgttattgtggaaatctattttccttgaatgtagctcctctaaggtacttaaaattatagctttagtcttgtttacaaaatttacttcaggtgctgaagtaaatcccattcaacattaagagaatcttcatgaatgtagcagtataattggacctggtggccctctctgaatattattgagaaaggttgtggtcatttctttctattttttaatagagacagggtcttgctctgttgcccaggctggagtacactggggcaatcatagctcagtgcagcctcaaaatcctaggctctaccaatcctcccatctcagcctcccaagttgctggtactactgacatgtaccacatgtctggctaatttttttaaaacttttttgtagagacagggtcttgctatgttgtccaggctggtcttgaactcccagcctcaagcaatcctcccaccttagcctcccaaatcctgtgctgggattacagaggtgagccaccatgcctggcaaggttgtggtcattgataggacgttttgcaaagcatccttgaaggaaagaggatatataaatgcaaattaatgactgaaaatataacctgtgttttgacatgttagaatacataattacagaaaaattattaaaactagtaattttgactggaagtatactaggaacaatcagaaatctttcaggcagtagtaaattttcttctgatacttgatttgcagttattttgctagttataacatagtttgtcaatggtagccatttctgattggtcatcttatatgaaaacaacttgaatgtttatcagcaagagagtgtttgaataaattctggtccatctataccaagatatattatagggctattttttaaaaatgaatttgaacactatcttttgatttctagagatgtttatgattcattgataaatgcaaaaagcaaagtttcaaagtaataatccaacatttataaaaacaactaatcacaactaatcataaacaaaagaggtttataaaaacctctatgtgtgtagagaaactcttagtcaagttttcataaagaaggaacttctacctgtaacggaagcagattgggaagaatcattcctatttctgtccacccttcacttacaagaggagagggcaataagtatttactactgaaaatacacatgcattattttagtaattttttaaaattaaagaaaaatgtgaaagaaaatgtattttttctgatcataattgctctccctaatttaaccttgcttttaattttttaggtagtgtacattctttttcaaatggaagagctggttatagccaacaacatcagcatcgacatagtggacatgaaagagaagaggaaagaggagatgtacgtttatgactagaaatcacaaaatggcaaatttcagctcaggaaaagtaattagagttgtctgaaaagagggcaagtagttgtaggaaataatgagttttctcttactagaggtgtttggtagagactagaaaatccttagggacattgtaggaataggaagagaggtcagccaggggtggttggatagtatgacccctttagatttgttattctatgattctaatgaaggtacacctgcactatgcatgttgtgaaggtaacttgttattgttggccctgaagaatttagagtactgaaaaacttgaattggaggtaactttccttgttctaatgcagttatacctaattgcctatagcaatttaattacatgaagtggaaaggtaaatggaaagagcactagactagaaattaaaaggcctggcccccagctttgccactcatcagctcccatcttctaccctcaaatccaaggtaaaaaatggttttacagcctgcagcatattgatagcgtctctgtgtgtgggggggagggagtcgggaaagagaaagagaaagaaatgaagacttcctcatctataaaatgaaatcaaattttatcagtgtttttcaaatcagaatctcctggtgatatgcctggataattatatttaagaatcatcctattggcatggttacgcagatttgaaagcactgaactagatgatctcaaatgcgctttctgcctcaaaatgtatgacaactgttgtattattaacaactacagttatattacaatttgttattctttgatcattttttatagggaggtttttctgtgtttatccagctgatgcccataattgtattgatcctcgtgtcattattaagccagttgatggtctctaatcctccttattccttatatcccagatcgtaagtagccaagtgaagttttacaaaaaatgaattgttgctatttctgacctagcttcctttaaagagcttgtgctcttttaaacttttaagtgccaaatctattactgcaagtgtaccagattttaaatttctatctaattttttaaaatagttactttaagtaataaatttgtcttatgttgttaatttacatttctattcttccactgtggataaggacagaaatgctatatttgaacttgataacaatttaatgtggtaggtaatgtgttgacattaaaggcaaaaaatactctaaaggacaaaactaaagacagagcaatgattgatgttacatagatttatatcattaaggggaaaatgactttactcttcattttgcaaaatatcgattaaataaaagcaaatattacttttttatgatgtatttttttcaccatatactttatgtgtaagaggtcaggacataaaggaaatttaatacagcatgcaatctagacaactttaatacagtgaacataaaggaaactataacatcatattggctgttatagcagcatgaataaataagaagcatataaagaaaaaataataaaaatcagtgattttacagtattaaaatcacattggtctaaaaataacaattaccttatttcttccaaataagatttttattaacaaaaaattgagataactttataaaaacacagtatatttaaaagtgtggttactttttgtgacatgaaatcatggttttaggcaatttgagataacgtaaataaattacaagttgatttttgtaatttataatacaaataagatttttattaacaaaaaattgagatactttacaaaagcatagtatatttaaaaatgtggttactttttgtgacatgaaatcatggttttaggcaatgtgagagaatgtaaataaattaaaagttgagtatttcttatccaaaatgcttgggaccagcagtgttttggattttgggattttggattttttcagattttgtaatatttgcatatattttatgagatgtcttgaggatggtacccaagtctaaaaatgaaatttatgttttatatataccctattcacacagcctgaaggtaattttatacaatatttttagtcactttgtacatgaaacaaagtttgtatacattgaactatcagaaagcaaaggtatcactatctcagccacccatgtggacaacctgtggttgtttggcatcattcctgactctgaatttatatgctactgataagcaataattttcttactctaattcacatataagtatttaacagtgaaaaaataatgtattcaggtttaaataaccaccagcatattagcatcaccagaatacccgtgtcagctgttaaacaatagcaacgacaaacaactacaggcttttagtttccacctatgatgctgtgttttgattaaaaggtgacccatcacatgaggtcagctttggaatttttcacttgtgccatcttgtcgatgctcagaaagtcttagattttagagcatttcggatttcagagtttcggattagggatgctcaacctgtattaccaatattaacttttcaatgatttttaattgtttttgtttgcttggtttatagcagcatattggaatgtccaattttaattaaaataatgatgcatctcttttacagtggaactgggcaaactattaaaatgcaaacagaaaacttgggtgttgtttattatgtcaacaaggacttcaaaaatgaatataaaggaatgttattacaaaaggtagaaaagagtgtggaggaagattatgtgactaatattcgaaataactgctggaaagaaagacaacaaagtaagtttgtcatgtgtttaacattttaaaacttattcgcagtctttggaactgattaatgtagatttccctattcaaggaatgttctggaattccctggcacataattggagcacagtacttaaatgagatcatgtgttttatatacatgtggcctaacatcggaattgacacatagtaaggacttaataaatggtacttgtctattgttatcaataaatatttggttgaataagtaataccaaattttattgtattgataatatccatcataagacacatcattcttttatgtaccaccaagaaacaaaaaatatcctggcagataaactatgtcatcaattttaagatgcatactgttttcagagttaagtttgaaactctattaatttagcttttgtatttagaatttaatgtacaatgagttttgttgacatttcttttttctttactttgtacacagagagactcttcagaacacttcatttgcttaggcttttccagcctcagttttcttaatttaaggaacagttccatctataaagattgatataagaatctgctgagatgttgcatgtgaattgagtgttgtggttcttgtttttgtgaccattgttgtgaataataatgtagaccatatagtgtagtgttaggagaactgactttggaattaaactgagtaaagttgaatcctagctctgaaatttttagctgacgaattgtaacctctatgagtttcatgtgtaaaatgggtgatgatgagtgggaggaggaaataatagctatcatttatataatgcctgtttcagtcactgtcccaagcacattgtaagtattaactcatttaatcttcacaacaaccctgtgagattatacttattttacacatgaagaaactgaagcaaagagagattactaacttgcccaaggtcatagaggtcgtttgtgattgaaaaccagacaatttgtctctagaatccaggccctgtgctccaacgtcttctcagaaataaccaactttatggggtttgttgtgaaaattaaatcaggcaataaagtacttcacacatagtgaatgctcagaaaatgtcagcaattatcatcatctcccccttgctagggaaaagttgataaaatgtaacttctaagagagtccttaacctctctggtcttggttttctcctctatttagtggcagttagagatgtgacctctttgacttctaactcaatgagtttgtgaaatcagtctgtcctcagtgtggagaagcttacattagactagtgatttttatgttttcagctgggagtgagttgccacccttcccccaccccacccatccctagagatgtttggtaacgtctggagatacttttgtgtgtcatcatgggatgggaatggaaagggattgctactagcatctagcgggttaaggccagggatgctgctaaacatcctacaatgcacagaccccccacaacaaaaaaattatccagcccaagcagtacttgaaataatggaaagaatattaggctaggcattggagagttggactggaatctagactctgccattcgttagcagtgtgaacttcggtttatctaagtctcaaatttcttctttgggaagagtcatctgtaaatagatataagcgcattatgtgtaaataaaaggcataggataatattgattgagttgttaatcctagtccagttgatttagtaaagattatttctggagatctttacaaatggaatactgtcttaactgtgagtatatcttgaatgtgatcttgactaatccatataaaccagatgtcttctactttggccattgtgttccagaaagtaactgatttctttttctgttacatcttctttaagtgctcctagtctttacaggtattaataaacagtgaaatgactgagagtaacaggaaaaaacaagaaatactccttgaagaattttgatttgtagtctgtatatcattagtagctgtgctgtcccacacactgaaggaagcctcagaagtacttatttgctgaatagcaatattacgatcgtataacaagcattttttttatctgtgttccttcagtaatattattatatgtattttttaatttaagtaaactcagaacaagattttaaattttttattaaatacttaagtcttgggataatctgaaatcttaacagaaggccacagtgaaacaaccactggcagtattgaaaagcatataatatttttaggaaaagagtccaagatgatgcttcagaggaatagtttttaaaccactggggaacaggagtagagagaaaggattccaacgtgagttgacaggattctatccttatttattttctgtgtttgttttacctgctatacttcaaataaagttttcattaaaatttttttcctactaaaatggcttttaggaattgtactttgattttttttaagtcagttaatcaaaatatatcaaagggctcctgtaaagcatcacttgagcttaagcaactaggtgacaaaaattttattcaattagcaaaatatttttctttattaacagaaacagatatgcagtatgcagcaaaagtataccgtgatgatcgactccgaaggaaggcagatgccttgagcatggacaactgtaaagaattagagcggcttaccagtctttataaaggaggatgaactggaatttttatttataccttttagcgtactctttattttttctgtaagtaagtttggtttcatcatgagggatgaaggaaaagatttgatactgaaaactaaactgaatagttggttcctgaaatcttggactgtttatgacctactggctcctttaaatagtaactgaaaactaaaatggaatattttagttaacgcttctacaagtattttcattttaaaagcttacatgattcctaactaaagtgtcatgagaaaggattatcacacctgtagcaatttccagttttagtgattctccattttttcccttgtcatgtaaatatttatggaatgatcattttgtgtacatacaggttactgcttttttatttaaattcttttagtgtttagctccatgagacacttcagtttaaattgatggaataaatgttatatgacacatttacattttccttatcaaggtgtcaaatatgtggactttaaacaatgaaactttttcaaaaagaaaaaacaaaaactttaactttgtgtaaaatcttatagtattatcagcttagagggaattgatatttttaatattgccgttatattccaaaatatatattgagataaatgaactggtgtagaatatcagtttgctatttagttttatgaattactatacatatacatgcatagaaatgaaatgctatactgataaattttaaagaaaatatgaggaaatggctataaatattaaactaaaagggtcttcaacagtaaagtgcagttatgtcatttaaaattccaatactttaaaggccaccaaattttgatgtatatgtccttgaagggctgctaaaatttatgaagaggactcacattttcccccatagaaatttgcagtttcttggtgatcatttaagcaggatccaaagaagttcctttacaaataagtaataagaaaaatgagtactaaaatacagctttgtgccttttaaccctatgccaactcctaaacatataagtagattacagtatacttatctgatcagagcatgatctgtttggccacatgcaagtgtgagcagaaatagagcagcacgtagaatagtaacttaaagcaagtcatcctttaaaaattctgagctaaaatctatttaccattgagtaattgaattaatcccataggaataagctccttgtaagtaaatccatgatatgaattagaaaaaaaaaacagctggaaattgaagtttttgatgcctgtatactggatatgaaactatttgatttctagtcttctgtgtttagcagttgtaatattttaatgattttgcttcatactcggttaatggaacataaacatatctttgatacttctttgtgagtgagagaatgctagatagggtggctttgttctttgtttaagttttttttcctgaatgtagttaatttatggcatctgttgaataaaactgctaaaatgacctcttaaaaatgttctgttgtatccccttttccaggtgaatcaatagaaatgcctgattgaattagtaggttaaactaaacaacatactgtcataggaaaactggagagcttaaccaacttgctcttagaaatgttaccttaaaaaaaaaaaaaaagcagtgcttaagagaaaatacaattttaattattttgttgagcctgcagagtaagtttttaaaaatataagttcatagcattttaattaactttgaaagttcatatgcatcagaaaatttatgaaaatttgaatgaaaaaaatttcatctatttatttttctaattttaatggcaaatttacactattatggctgataattctgtgaacttaccttcttgttgactgattctttttcccttaatcccagctttaaggagataggtgaagttattgtacaaagttaagtgataccataaagtatatattataaagtcatacatggcttttggacagtattatatttcagttgcagtgctgcattccattaaatttcataaaatgctagggaaaatgtgtttgataaaattttctgcagtgagaaatgacagactgagtgcctgacaatttaagccacatatgaagtatgcaagtaaagattcagtccttaatgtcatctatatcatggtataaaagctcaacaagtatcttataatttggagttaactttataaagtaagaagagtttggatatcttgataaaagattttcatgtttgctgctttttttataataaaaatcccaacattttgccatcttatgtttagctacatgaacttcgcaatttcatcggctcattctaatgaccacctaaaagtcctcaatctttgaatattgctttattagctcctctaactggtattctaacagtttagcagcacttatatttattaatgctttacatttttacccctttttgtgtaaacacaaatacacccatgcatatacacacaaacattattgtccttgtgagggtttgggggaaatgaaaaatagtacctttctcctcttcttttgattccttagttcccaaatagactggtgctagtcatttagtcatctgtaaatttcgaaatgtagtttgattaaatgtgaactgaattctcagcaatgaaaaatgtcaagttgaattcatctaataagtgaaaataatatattttgtaaacagattacatttgaacacctaaataagtatttgtttcataatcattacatgcttgtttatgatttacaaagatttggtagagaaaagtacagtccttaaggcatatatatgccaatgcattaaactactcagcttttgtgccagctcaggtgttcataggaacaggaatgtggaataccagctttttactttaattatacttttatgctgaatttttcttccagttaaacctttaattacactagtatgtaaagtagttactgagaaaaataagtttttgatttcccttctgttgatctgtaacatttttaaatgaagctatttaacacatgacatgctaatgttacttaatggattcctatgtatttcattaaaaaaaagtctcccacctgtgttaagacagctaaatatttcttgatgttggcttgaggaccaagtgagccatcttgccagttaagcaagttttatatcagaggaccaaatggttaagaagagaatttgtacatttcttgagcttccccatgtgaagcttgggttcagtactatcctattactatccatcttcataatgagtgaagcaaactgaaagggaattcataatcttttttcttatctgaacagaaaaactaatgaaaatcaacaataaatctttattttaattttcattcaacagctgaaaaaccatgtctgttgaccacattggaccattgcctagttaaaatccataaaattccctataaaccaatgaaaagaaacttgtctggcaataatttccaacattttaaattctaatttttagttacaaagaaaaaggatagaatgaggcttttcaaggaattcttgctcatcccttcaattatttggcaggtaaaacagtcctagaattcagcttcctttttggttttattactattaaatagatactttcatataaatggaaacacttttcctcaaaacattaattcaaaacatactccttatattaaggattatagcaccatattttttgtatattccctatgtgtaactttttcctgttggtatgtgatatttttcatttaatatgactatctgctggtgttggggccaatagatttgtgaatattctgtggatgtgtctatgtataggtgtatatatatatatatatattttttttttttttcccagctaattacctcaaatgtgtgattgtttaatatataccacactatgtttgcacagagcagggcttccattagcagtggatatttttatgtctgactttgaaaatcagtcaacacaatttcattggtgtgaattatttgttgctctttttcatattttaatggagagattcctattataaggcccatgcttcaaacataattatatctttctatatccagccatctggaaatacataggggtaagaagtatttcttgaaatgtccttgtttagtaagttagtaaaaactgggatgactagttgccaagatgtcttgtaactgcatagcagatgacacctggcatggcaagtctcattcacttcagcacaacactctgtacatttcagtctgatattctactttgccatttaaggacaccattaaaatcatagagattttcagtgacattggagtattgtaattattactttcaaaaaattatttttaataggatgattaaaccaatgagaagaaacacacataaatgatattttgcagtttatctgtattaagaaatgcttcttgccaatttctagttttagtttttggattgctacataagactttctttccatttactttatgtgtttttaaaagctgcaggtaatttttaaggtttgatggaattataatggaagccttgtataagttaaatgaaattggtaaaggagagcttactttgtctataatgcattcaggattaaaaattagatttcaaaatgaaatgtctgatttgtaaaatatttaatgttatatcagacttacataaaattttctgtgagaactcaaatgcatttgatttttaatgaatgttctgaatgaaatatgaatttttgtctttcagtctctgtagtttatctcaatatattaataaaaaggtctgttctcactgtaaaa

SEQ ID NO: 12763 - DNA, 12582 bp, Homo sapiens
tgaagaacaagcatgtaaccaccaaaacaatggcagatttaatttccatagaggttgtgaagctgatataactccagaagacttgtttaatatattttttgggggtggatttccttcaggtattttaatgtaattatagatattatattttatgaagctacatagtcttacctccagttaacgttatttagagatgtatctaccttttcccctacatttcttgtagtgttacgatcctgtaatggtttttcatgaaagcaggagaaaaatattagggttattacttttataatagcctgcctttttcctagaacatattttaatttaaaaaaatgaagagtacagatattctgtattttatataaagctgaaagggaatgtaagcaggaaatgtaatggcaatgtcttaggtaagtactattataattatgaatggttttctttacttaaacctggataactatttgacattgcttccctagagatctttgtaaatattttatcaataacattatagttggctaatttggatatatgtagaggtactcatctctatttccatttaaacagtagaaaatctgattcataggttatatacaaagtaagtggatttttaagtttacattaaaatagaaatagctaactttaactagactatcaaagtgaaatattgtagtgatactaagattttatagtaccaacataaatagtatcaaactccacttacatttacagtaagtggtcacttaacataaggtttttggaaactgtgactgtaagtgaaacaatgttctgtataacaactaattttaccgcaggctaattgatataaacaacagttaaattgctaaggcatatagtacatcatgtttacttgaagttgcagtttccaaggacctcttgatgacgttaagtgaggacttactgtactgtgagttgttattgtggaaatctattttccttgaatgtagctcctctaaggtacttaaaattatagctttagtcttgtttacaaaatttacttcaggtgctgaagtaaatcccattcaacattaagagaatcttcatgaatgtagcagtataattggacctggtggccctctctgaatattattgagaaaggttgtggtcatttctttctattttttaatagagacagggtcttgctctgttgcccaggctggagtacactggggcaatcatagctcagtgcagcctcaaaatcctaggctctaccaatcctcccatctcagcctcccaagttgctggtactactgacatgtaccacatgtctggctaatttttttaaaacttttttgtagagacagggtcttgctatgttgtccaggctggtcttgaactcccagcctcaagcaatcctcccaccttagcctcccaaatcctgtgctgggattacagaggtgagccaccatgcctggcaaggttgtggtcattgataggacgttttgcaaagcatccttgaaggaaagaggatatataaatgcaaattaatgactgaaaatataacctgtgttttgacatgttagaatacataattacagaaaaattattaaaactagtaattttgactggaagtatactaggaacaatcagaaatctttcaggcagtagtaaattttcttctgatacttgatttgcagttattttgctagttataacatagtttgtcaatggtagccatttctgattggtcatcttatatgaaaacaacttgaatgtttatcagcaagagagtgtttgaataaattctggtccatctataccaagatatattatagggctattttttaaaaatgaatttgaacactatcttttgatttctagagatgtttatgattcattgataaatgcaaaaagcaaagtttcaaagtaataatccaacatttataaaaacaactaatcacaactaatcataaacaaaagaggtttataaaaacctctatgtgtgtagagaaactcttagtcaagttttcataaagaaggaacttctacctgtaacggaagcagattgggaagaatcattcctatttctgtccacccttcacttacaagaggagagggcaataagtatttactactgaaaatacacatgcattattttagtaattttttaaaattaaagaaaaatgtgaaagaaaatgtattttttctgatcataattgctctccctaatttaaccttgcttttaattttttaggtagtgtacattctttttcaaatggaagagctggttatagccaacaacatcagcatcgacatagtggacatgaaagagaagaggaaagaggagatgtacgtttatgactagaaatcacaaaatggcaaatttcagctcaggaaaagtaattagagttgtctgaaaagagggcaagtagttgtaggaaataatgagttttctcttactagaggtgtttggtagagactagaaaatccttagggacattgtaggaataggaagagaggtcagccaggggtggttggatagtatgacccctttagatttgttattctatgattctaatgaaggtacacctgcactatgcatgttgtgaaggtaacttgttattgttggccctgaagaatttagagtactgaaaaacttgaattggaggtaactttccttgttctaatgcagttatacctaattgcctatagcaatttaattacatgaagtggaaaggtaaatggaaagagcactagactagaaattaaaaggcctggcccccagctttgccactcatcagctcccatcttctaccctcaaatccaaggtaaaaaatggttttacagcctgcagcatattgatagcgtctctgtgtgtgggggggagggagtcgggaaagagaaagagaaagaaatgaagacttcctcatctataaaatgaaatcaaattttatcagtgtttttcaaatcagaatctcctggtgatatgcctggataattatatttaagaatcatcctattggcatggttacgcagatttgaaagcactgaactagatgatctcaaatgcgctttctgcctcaaaatgtatgacaactgttgtattattaacaactacagttatattacaatttgttattctttgatcattttttatagggaggtttttctgtgtttatccagctgatgcccataattgtattgatcctcgtgtcattattaagccagttgatggtctctaatcctccttattccttatatcccagatcgtaagtagccaagtgaagttttacaaaaaatgaattgttgctatttctgacctagcttcctttaaagagcttgtgctcttttaaacttttaagtgccaaatctattactgcaagtgtaccagattttaaatttctatctaattttttaaaatagttactttaagtaataaatttgtcttatgttgttaatttacatttctattcttccactgtggataaggacagaaatgctatatttgaacttgataacaatttaatgtggtaggtaatgtgttgacattaaaggcaaaaaatactctaaaggacaaaactaaagacagagcaatgattgatgttacatagatttatatcattaaggggaaaatgactttactcttcattttgcaaaatatcgattaaataaaagcaaatattacttttttatgatgtatttttttcaccatatactttatgtgtaagaggtcaggacataaaggaaatttaatacagcatgcaatctagacaactttaatacagtgaacataaaggaaactataacatcatattggctgttatagcagcatgaataaataagaagcatataaagaaaaaataataaaaatcagtgattttacagtattaaaatcacattggtctaaaaataacaattaccttatttcttccaaataagatttttattaacaaaaaattgagataactttataaaaacacagtatatttaaaagtgtggttactttttgtgacatgaaatcatggttttaggcaatttgagataacgtaaataaattacaagttgatttttgtaatttataatacaaataagatttttattaacaaaaaattgagatactttacaaaagcatagtatatttaaaaatgtggttactttttgtgacatgaaatcatggttttaggcaatgtgagagaatgtaaataaattaaaagttgagtatttcttatccaaaatgcttgggaccagcagtgttttggattttgggattttggattttttcagattttgtaatatttgcatatattttatgagatgtcttgaggatggtacccaagtctaaaaatgaaatttatgttttatatataccctattcacacagcctgaaggtaattttatacaatatttttagtcactttgtacatgaaacaaagtttgtatacattgaactatcagaaagcaaaggtatcactatctcagccacccatgtggacaacctgtggttgtttggcatcattcctgactctgaatttatatgctactgataagcaataattttcttactctaattcacatataagtatttaacagtgaaaaaataatgtattcaggtttaaataaccaccagcatattagcatcaccagaatacccgtgtcagctgttaaacaatagcaacgacaaacaactacaggcttttagtttccacctatgatgctgtgttttgattaaaaggtgacccatcacatgaggtcagctttggaatttttcacttgtgccatcttgtcgatgctcagaaagtcttagattttagagcatttcggatttcagagtttcggattagggatgctcaacctgtattaccaatattaacttttcaatgatttttaattgtttttgtttgcttggtttatagcagcatattggaatgtccaattttaattaaaataatgatgcatctcttttacagtggaactgggcaaactattaaaatgcaaacagaaaacttgggtgttgtttattatgtcaacaaggacttcaaaaatgaatataaaggaatgttattacaaaaggtagaaaagagtgtggaggaagattatgtgactaatattcgaaataactgctggaaagaaagacaacaaagtaagtttgtcatgtgtttaacattttaaaacttattcgcagtctttggaactgattaatgtagatttccctattcaaggaatgttctggaattccctggcacataattggagcacagtacttaaatgagatcatgtgttttatatacatgtggcctaacatcggaattgacacatagtaaggacttaataaatggtacttgtctattgttatcaataaatatttggttgaataagtaataccaaattttattgtattgataatatccatcataagacacatcattcttttatgtaccaccaagaaacaaaaaatatcctggcagataaactatgtcatcaattttaagatgcatactgttttcagagttaagtttgaaactctattaatttagcttttgtatttagaatttaatgtacaatgagttttgttgacatttcttttttctttactttgtacacagagagactcttcagaacacttcatttgcttaggcttttccagcctcagttttcttaatttaaggaacagttccatctataaagattgatataagaatctgctgagatgttgcatgtgaattgagtgttgtggttcttgtttttgtgaccattgttgtgaataataatgtagaccatatagtgtagtgttaggagaactgactttggaattaaactgagtaaagttgaatcctagctctgaaatttttagctgacgaattgtaacctctatgagtttcatgtgtaaaatgggtgatgatgagtgggaggaggaaataatagctatcatttatataatgcctgtttcagtcactgtcccaagcacattgtaagtattaactcatttaatcttcacaacaaccctgtgagattatacttattttacacatgaagaaactgaagcaaagagagattactaacttgcccaaggtcatagaggtcgtttgtgattgaaaaccagacaatttgtctctagaatccaggccctgtgctccaacgtcttctcagaaataaccaactttatggggtttgttgtgaaaattaaatcaggcaataaagtacttcacacatagtgaatgctcagaaaatgtcagcaattatcatcatctcccccttgctagggaaaagttgataaaatgtaacttctaagagagtccttaacctctctggtcttggttttctcctctatttagtggcagttagagatgtgacctctttgacttctaactcaatgagtttgtgaaatcagtctgtcctcagtgtggagaagcttacattagactagtgatttttatgttttcagctgggagtgagttgccacccttcccccaccccacccatccctagagatgtttggtaacgtctggagatacttttgtgtgtcatcatgggatgggaatggaaagggattgctactagcatctagcgggttaaggccagggatgctgctaaacatcctacaatgcacagaccccccacaacaaaaaaattatccagcccaagcagtacttgaaataatggaaagaatattaggctaggcattggagagttggactggaatctagactctgccattcgttagcagtgtgaacttcggtttatctaagtctcaaatttcttctttgggaagagtcatctgtaaatagatataagcgcattatgtgtaaataaaaggcataggataatattgattgagttgttaatcctagtccagttgatttagtaaagattatttctggagatctttacaaatggaatactgtcttaactgtgagtatatcttgaatgtgatcttgactaatccatataaaccagatgtcttctactttggccattgtgttccagaaagtaactgatttctttttctgttacatcttctttaagtgctcctagtctttacaggtattaataaacagtgaaatgactgagagtaacaggaaaaaacaagaaatactccttgaagaattttgatttgtagtctgtatatcattagtagctgtgctgtcccacacactgaaggaagcctcagaagtacttatttgctgaatagcaatattacgatcgtataacaagcattttttttatctgtgttccttcagtaatattattatatgtattttttaatttaagtaaactcagaacaagattttaaattttttattaaatacttaagtcttgggataatctgaaatcttaacagaaggccacagtgaaacaaccactggcagtattgaaaagcatataatatttttaggaaaagagtccaagatgatgcttcagaggaatagtttttaaaccactggggaacaggagtagagagaaaggattccaacgtgagttgacaggattctatccttatttattttctgtgtttgttttacctgctatacttcaaataaagttttcattaaaatttttttcctactaaaatggcttttaggaattgtactttgattttttttaagtcagttaatcaaaatatatcaaagggctcctgtaaagcatcacttgagcttaagcaactaggtgacaaaaattttattcaattagcaaaatatttttctttattaacagaaacagatatgcagtatgcagcaaaagtataccgtgatgatcgactccgaaggaaggcagatgccttgagcatggacaactgtaaagaattagagcggcttaccagtctttataaaggaggatgaactggaatttttatttataccttttagcgtactctttattttttctgtaagtaagtttggtttcatcatgagggatgaaggaaaagatttgatactgaaaactaaactgaatagttggttcctgaaatcttggactgtttatgacctactggctcctttaaatagtaactgaaaactaaaatggaatattttagttaacgcttctacaagtattttcattttaaaagcttacatgattcctaactaaagtgtcatgagaaaggattatcacacctgtagcaatttccagttttagtgattctccattttttcccttgtcatgtaaatatttatggaatgatcattttgtgtacatacaggttactgcttttttatttaaattcttttagtgtttagctccatgagacacttcagtttaaattgatggaataaatgttatatgacacatttacattttccttatcaaggtgtcaaatatgtggactttaaacaatgaaactttttcaaaaagaaaaaacaaaaactttaactttgtgtaaaatcttatagtattatcagcttagagggaattgatatttttaatattgccgttatattccaaaatatatattgagataaatgaactggtgtagaatatcagtttgctatttagttttatgaattactatacatatacatgcatagaaatgaaatgctatactgataaattttaaagaaaatatgaggaaatggctataaatattaaactaaaagggtcttcaacagtaaagtgcagttatgtcatttaaaattccaatactttaaaggccaccaaattttgatgtatatgtccttgaagggctgctaaaatttatgaagaggactcacattttcccccatagaaatttgcagtttcttggtgatcatttaagcaggatccaaagaagttcctttacaaataagtaataagaaaaatgagtactaaaatacagctttgtgccttttaaccctatgccaactcctaaacatataagtagattacagtatacttatctgatcagagcatgatctgtttggccacatgcaagtgtgagcagaaatagagcagcacgtagaatagtaacttaaagcaagtcatcctttaaaaattctgagctaaaatctatttaccattgagtaattgaattaatcccataggaataagctccttgtaagtaaatccatgatatgaattagaaaaaaaaaacagctggaaattgaagtttttgatgcctgtatactggatatgaaactatttgatttctagtcttctgtgtttagcagttgtaatattttaatgattttgcttcatactcggttaatggaacataaacatatctttgatacttctttgtgagtgagagaatgctagatagggtggctttgttctttgtttaagttttttttcctgaatgtagttaatttatggcatctgttgaataaaactgctaaaatgacctcttaaaaatgttctgttgtatccccttttccaggtgaatcaatagaaatgcctgattgaattagtaggttaaactaaacaacatactgtcataggaaaactggagagcttaaccaacttgctcttagaaatgttaccttaaaaaaaaaaaaaaagcagtgcttaagagaaaatacaattttaattattttgttgagcctgcagagtaagtttttaaaaatataagttcatagcattttaattaactttgaaagttcatatgcatcagaaaatttatgaaaatttgaatgaaaaaaatttcatctatttatttttctaattttaatggcaaatttacactattatggctgataattctgtgaacttaccttcttgttgactgattctttttcccttaatcccagctttaaggagataggtgaagttattgtacaaagttaagtgataccataaagtatatattataaagtcatacatggcttttggacagtattatatttcagttgcagtgctgcattccattaaatttcataaaatgctagggaaaatgtgtttgataaaattttctgcagtgagaaatgacagactgagtgcctgacaatttaagccacatatgaagtatgcaagtaaagattcagtccttaatgtcatctatatcatggtataaaagctcaacaagtatcttataatttggagttaactttataaagtaagaagagtttggatatcttgataaaagattttcatgtttgctgctttttttataataaaaatcccaacattttgccatcttatgtttagctacatgaacttcgcaatttcatcggctcattctaatgaccacctaaaagtcctcaatctttgaatattgctttattagctcctctaactggtattctaacagtttagcagcacttatatttattaatgctttacatttttacccctttttgtgtaaacacaaatacacccatgcatatacacacaaacattattgtccttgtgagggtttgggggaaatgaaaaatagtacctttctcctcttcttttgattccttagttcccaaatagactggtgctagtcatttagtcatctgtaaatttcgaaatgtagtttgattaaatgtgaactgaattctcagcaatgaaaaatgtcaagttgaattcatctaataagtgaaaataatatattttgtaaacagattacatttgaacacctaaataagtatttgtttcataatcattacatgcttgtttatgatttacaaagatttggtagagaaaagtacagtccttaaggcatatatatgccaatgcattaaactactcagcttttgtgccagctcaggtgttcataggaacaggaatgtggaataccagctttttactttaattatacttttatgctgaatttttcttccagttaaacctttaattacactagtatgtaaagtagttactgagaaaaataagtttttgatttcccttctgttgatctgtaacatttttaaatgaagctatttaacacatgacatgctaatgttacttaatggattcctatgtatttcattaaaaaaaagtctcccacctgtgttaagacagctaaatatttcttgatgttggcttgaggaccaagtgagccatcttgccagttaagcaagttttatatcagaggaccaaatggttaagaagagaatttgtacatttcttgagcttccccatgtgaagcttgggttcagtactatcctattactatccatcttcataatgagtgaagcaaactgaaagggaattcataatcttttttcttatctgaacagaaaaactaatgaaaatcaacaataaatctttattttaattttcattcaacagctgaaaaaccatgtctgttgaccacattggaccattgcctagttaaaatccataaaattccctataaaccaatgaaaagaaacttgtctggcaataatttccaacattttaaattctaatttttagttacaaagaaaaaggatagaatgaggcttttcaaggaattcttgctcatcccttcaattatttggcaggtaaaacagtcctagaattcagcttcctttttggttttattactattaaatagatactttcatataaatggaaacacttttcctcaaaacattaattcaaaacatactccttatattaaggattatagcaccatattttttgtatattccctatgtgtaactttttcctgttggtatgtgatatttttcatttaatatgactatctgctggtgttggggccaatagatttgtgaatattctgtggatgtgtctatgtataggtgtatatatatatatatatatttttttttttttttcccagctaattacctcaaatgtgtgattgtttaatatataccacactatgtttgcacagagcagggcttccattagcagtggatatttttatgtctgactttgaaaatcagtcaacacaatttcattggtgtgaattatttgttgctctttttcatattttaatggagagattcctattataaggcccatgcttcaaacataattatatctttctatatccagccatctggaaatacataggggtaagaagtatttcttgaaatgtccttgtttagtaagttagtaaaaactgggatgactagttgccaagatgtcttgtaactgcatagcagatgacacctggcatggcaagtctcattcacttcagcacaacactctgtacatttcagtctgatattctactttgccatttaaggacaccattaaaatcatagagattttcagtgacattggagtattgtaattattactttcaaaaaattatttttaataggatgattaaaccaatgagaagaaacacacataaatgatattttgcagtttatctgtattaagaaatgcttcttgccaatttctagttttagtttttggattgctacataagactttctttccatttactttatgtgtttttaaaagctgcaggtaatttttaaggtttgatggaattataatggaagccttgtataagttaaatgaaattggtaaaggagagcttactttgtctataatgcattcaggattaaaaattagatttcaaaatgaaatgtctgatttgtaaaatatttaatgttatatcagacttacataaaattttctgtgagaactcaaatgcatttgatttttaatgaatgttctgaatgaaatatgaatttttgtctttcagtctctgtagtttatctcaatatattaataaaaaggtctgttctcactgtaaaa

SEQ ID NO: 12764 - DNA, 5572 bp, Homo sapiens
atagagtgagactccatctcaaaaaaacaaaacaaaacaaaaaccacatcttttcatcctgttaaaacacagcacctcatggttattatgacttaggtttctttaactctgagtaccgtcttcactgaatttttgtggtcttcttgaattccttacatctgtcattacacactccctgtcccctcatccccacagtcctcctggaggcagctccctcataggagcctgtgtgctctccccaactccaggttcatcctcacttttcctccatgcagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatgtgagtcctggggagactgcatgtgagtgtgtgggaagggagaattgaacgggaagaggagggacctcttgggagctgggttccctgcagggttctagtggacatcctatgaggctgtgcactgcacagtctgttaggcaacagtggcacccctgggctctcttgtacagacccaagaggctcaccctgaaccccttctgagagccagccccagggtagggggtgggaggtggggggccctgtgttgcagaagatgacatgggatggaaagagaactaatatttcttatttcccttctcttcccttcattcgaccctcttctgatcactctccatccaattgcctctccccaacaccccatcccccatattctcatcctcttgttctctctcactttctgtctggtgtcctatcacttgttctgtcactcaccccctctgtttttatcccttgtaccccatttccattgcctgcctccagcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctgggtactgtagcatcacctctcctgtctgccagtgtctgctacacccagggactgccccgcgtgccccctaacctgttttatttcccacccaagaggccttgtggccggctaccccttccgccagcccttctagggcagcaccaacaccccttcacccctgccaaaggcccatcttctccctccctccagcatcagtccttctgctcgatgacttcttcccctcacagctggccctgccactagaatcctggccctatggggagaggggagtggggggtacagacacaaagagagggccaccccctcacacccccttctccatctcctctcttcacagacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaccattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgatactt

SEQ ID NO: 12765 - DNA, 239 bp, Homo sapiens
gatcacctgaggtcgggagttcgagaccaacctgaccaacatggagaaaccccgtctctactaaaaatacaaaattagccgggcgtggtggcacatgcctataatcccggctactagggaggctgaggcaggagaattgcttgaacctgggaggcggaggttgcggtgagccgagatggtgctattgcactccagcctaggcaacaggagtgaaactccgtctcaaaaaaaaaaaaaaa

SEQ ID NO: 12766 - DNA, 373 bp, Homo sapiens
cctacacatgattttttttttctttttgagacaagatcccacaggctggagtgcagtggcatgatcatagctcactgcagcctcaacctcccaggttcaagcaagtctcctgcctcagccccctgaataactggaactacagtgcaccccaccaccctagctaatttttaagctatttgtagagatggagtctccttatgttgcccagtctggtctcaaactctgggctcaagtggtccttctgccttgacctctcaaagtgctgggattatagacatgagccactcgcccagctgtttttttttttttttttaagttcaacactatttttaaaaaccacctcttggtcggatgcggtggctcatgcctgtaa

SEQ ID NO: 12767 - DNA, 4936 bp, Homo sapiens
gagcggagccccttcctgggaagggtggattccttcctaactatctcagtaaagaagccgtagccgactccctttctgcctagagggcccgctggtccttgctggctttacccacgtatttaatacgcctcttaatttatcattctccacgcagcttccaaggcagacagactctggggtactgtgacttcttgcctcccatggtgtggagagtgagtttcggacacctcgggcgcccctgggcctgatccctcctatcacagcatcactggaggctcagaacccacagcctttgctttctgtccatgtcagcatccctgccttaagagaactcctcctggccaatggcattgccacccagcagtgggaccaagactctccaagacctccaggactggatcccattgcctggagaaactccagcaagggtctctcatggcttggacatggcacagtaaggggcagccaacccagtccatgatgacttttgctccaacttcttcatgtttctaaaagcccagtggctttattcactcctcctaaattgcctgctaccagaaggaacttcatcctgaagaaatgcattccattaccagttccagggaaagtgtccccttccccaaagcctcaggcccgtgggcctctgaggttccactggatgcggctcccccaggagtgggcctggagatccgctcagccgccctgcctcccaccttctatcttgggaccgtggtcagccctgaagggtggttccagccccgcgtatgctgcgctttgctgctgcaggctccggtccctccagggcttttcaatgagagttcccaccccaacttggagcatttcatttttgcctacctaaagcaagaatctcaaagtttgtttgaataagaggcccattcacaagtcgtgcccttgtgagcacccctttgctgagtgcctcgtgggtgccaaacactgtacttggcgctttgcattcatgctttgaccctcacaacctccctttatagatgaggaaattcacgctccatgtgcccaaggacacaccagccaggaggaagagggaagaggatttgagtccaggcctgcctgacttcagtgcctgtgccctcccctctgtaaaagacaaaccaggcagggaagagatagaagctggctaagtggtggccaagtggcttcattgtgaggggggtgagggggcattcgtggctgctcccacacccaccatccctccagcccacagcagcctataccaaaggctgccctggactcaacagctgcatctccatgacaggagaatgccagggtcctggtggttgacacagagccctgttccctcttctaagctgttgccccctggggaatagagcttatggagcaacgggagctgaggtggcctcgagggccagcctggagggctctgagcatagcatgcagcggtcccatagggaggcaggtaaccaagggccaggcagagctgcttcctgtgcctctccggcatttgtaatgtttttttcttttttcacgcactgccaaatctgttttctcccttgaagaaacccagggcagatgtggtcatctgtcaaactgaggtctggagaggcatgactaaatcactgcagaagcaaaatcaggacccagcatttctagctcccagcccagagtaagagagcagagcagaaccccttcccattctacccgaccgaggcagccctgcccctgccctgccccgcccctccccaccctgccctgccccagagatctccagttcacagtgttcatcaggcgagatacttttggacccacaaagccagttttttgggggggatgctcagtgtctacctgcagtgccaaagttttgcttgaacagccctcttctgccgcgcctcccagctccacccctatcacgtgggtctggctgcttctgcgtgaggagcttcctcgtgatcacctgtagcatctttagtgcctttcgtccagtcgggcctgcaaatcccttttcccagagaggcttgggcagggcccacttgccacttggccctgtgcccagagcgttgggggcagatggcagccaggggaagaagggaggtggggaagggccgccaccgcttgagggtcccctcccttgagaggaggccccatggcagttttcctgagttcttgatccactttggtttaaacaacttttgtgaagctatgtgagatttgactgcatttcaaaagacaaaacacatgtttttttctgatttgctctttgcctttcagcgacgctttcagatactttgtgagtgtctactctgtgctaggtgctgagtagactgggatgtgtgtggctccatccctggctggaagagctttgagtcctgtctgctgacttcactgaaggagtttctctcttgcttcattccttcctcccgggggtcagctgggtaggagcagacttgccctgccttcctctaggcagaaagttttcctgcaaatgaaagaatctgccattctcttttgctatgatgatgatgattattctgacatgacccgcgggtactgaagccacagtcctctctgttcactgttctctccttgagtcatatctatggcctgaggacgtctgtatccagctccttttcctacaatggtagacacttccccaggcagtgggtgggtcagggtggccagtcactctcctagctgtccttgcctggggacttagatttaccccatccaggactgtggtcgctattctgtgagcgattgatggcgcatatgcagaactcccctggagtcatggctctagaaagtgtccaggcccatcgtgacaatggtgccaagcaccgggctggtgaccagtgcctaaacacacacgctcctttaatccttacggcaagcctgtgaggcggataggaccagccctgatctatagtgagaaaattaaggttcagagggagaaggtccaaatagtggccaagctgggactgagatctcgagtttgggtttgtttggttttgttgttgttgttctttccctcgtgtccatgacttttctctgccattagcagggaagtgtgcggagggcttccagggaatcaagtgaccctccctctgaatttcggtgcctcttccccccgccccttgctcacacatttcagtaggtcacaggccaaatggcagcccaaaaggtgggcagagatttttttttcttcccctcacccctgcttattaacacaattgtgacaactactttaccttacatcccagggcaaacggacagcttgcggtacctccaaaaatttggaaaaccctgagtctaagaccacctcttgataaaagaggcctttgctcacatgttctgctcggaatctttctttgccattggtgggtgtatgtcgtcccagctgagactgcgggagagctgagctccagcttaaaccgcttttaatggcccttccctactgggggatcgctggagcccatgccaggttacggtagtcattttaaacctctgccacaaggccacgccatagaatcaatttccaagtcaatgttcttggccctaaaatgtttgcgcccactgaggatttcattaccaggtggaagatgggggaacatatgccacgttaaagagcaagtgctgagtgtgccaggacttgagaaggaccttaggctgaggagtggacagtctggtatttatttcgcctctcccaagtacccagcacagagtgggaaaaagaagaaactgctcctgccttccagtagctggcaacttgacatcaagaacaaaaacattcgtagctggacccccgtcctttcatcgtgcccaagtcttacatgttggcttaagctgcccccttggaggccgtacctttctctttggactgtgacagtggacacctaacagcctgagccatgtgtggctgtcttatcccccaagggttgtccaggcccgttctgcagggctgttgtgtagactgcagacatccatacctcaccacagaccaaagatgacctcgtgtcagactgtgggctgatgagaggtagagcagcatgcatcgaggcctgagggtgcagggcgccctctcttggcctggaggaattgctcctaactagagtaagtttccacgagggtcccaggcagagctgcagagctggaaccggaggctccacagtccttgcctgctcatggacctccttcagagcacctttctacagactggactgcccagctccgtggggtggcatctggtttctggtgctattctgccaagttatcgagctcctcctcatgtttcaacattccatcttcccgtttctatcctcgactccaaagtaagccttcttagctccaatcagggatgaggggctcaacctcttctgtcctcaaagaggccaaacgcagtgccacagtcggtagccttcacttttagatgtcctattcatgtaaaaagaaggtgcccccaccaggcttacatcagcaataagcaattctaatgcaacgatggtgtccacattttaccccagtgtgtgcccatgtatgcctttgtgcccgtgtaattattgttagcgcccctttcacttagaggggtgatgataaactgtggccaccttgattacaacccacatttcctgctttggggagcttccaagtaacaggccatttcttacctccctccaggaacagtgggcactgcccaccacctcgtgtctgctcataggatgacgctggagatccccacacttactctaccctcttggcaaattggcattccggtggtggtttttgtttcctttaacacattaaataaatgagtatataggatgtgaggggaggggtgagaacaactagctgtagcatgtgtaggctatatactttaccatttgacttctttcctttttttttttttaaataaaaaaagtgcttgactggtttcaagcttcatcatgaa

SEQ ID NO: 12768 - DNA, 1139 bp, Homo sapiens
ccccatcagtagctacctctggcattgtggcagatggtcaccatgtgtcagatgataaacatccacctctggattaattcctcattagggtacttcagatgttaactaataccattagggtgtgagtggaaactaacccagatacacataaatcacactggaaatacttctatattgaagtgtttaaaatttactatagatagtgtaacactttctttgctggagataaaatttatgttgttaaaagagaaaatgcaatattctttaggatgtacagctttaaagctgcattaggagtaaaacacaggaggtacatgcagcatttagtgatcatttctgctcttttctgtagtcttctaggtactctaatcacaaaatgttaatgcgcatctttaggggtaaaataatgtgctctaaagaatatggtagtcactgataatttgtaattatttactagattttttgttactaaataattcaatggtatgactatagtatcagtaatcagcctgctgaagaatgaataatgcaatcaatttacattcttttgttgccattgatagaccagtaacagcttacctttcctatattctgtaggcatctaagaagaaaatataccaaaactttaagatatcaaaatatatttttcagaggtaaaacaatgaccctcgtaaatacatagtaagtgcgtgtcataaatttatttgcctgatgaatgagggaatcaacataatggtgatgctgattcccagaaaattccacagataaattatatataggcctgataaaaatgctaaaataagattgtaagatcagtaaattgggctgggtgcagtggcctgtaaccctagcagtttgagaggctgagacaagaggatcacttgaacccaggagttgaagaccagcctgggcaacatgtcaaaactccatctctacaaaaaatacaaaaaatagctgggcatgatggtgcatgcctgtagtcccagctacttgggaggctgaggtggaaggatcgtttgagcccagaatgttgagactgcagtgggctgtgatcatgccactgcactgtagcctcagcctgggtgacagagtgagctcttgtctccagaaaagaaaaaagaaaaaaaaaaaaaaaaagg

SEQ ID NO: 12769 - DNA, 340 bp, Homo sapiens
gcatggacatggatggagctggaagccattatcctcagcaaactaacgcagagacagaaaaccaaacaccgcatgttctcactcataagtgggagctgaacggtgaaaacacatggacacagggaggggaacaacacacactgggcctgtcggaagggcgaggggagggagagcatcaggaaaaattgctaatgtgtgttgggcttaatacctaggtgatggattgataggtacagcaaaccaccatggcacacatttacctacataacaaacctgcaggtcccgcacatgtatcccagaacttaaaataaaaataaaaattaaaaaaattaaaaaaaaa

SEQ ID NO: 12770 - DNA, 884 bp, Homo sapiens
tatagagaaggaaaagtgggcgcaggggacccgcgctcagcatacggaggacccgcgccggcaccagcctctgagttccctcagtatttatcgatcattatcgggcatttctgggagagcgggatgtggcaggacaatagggtaatagtggggagagggtctgcaggaaaacatgtgaacaaatgtctctgcatcataaacaagttagagaaaaaagtgctgtgcttttgatgtgcatatacataaacatctcaatgccttaaagagcagtattgctgcccgcatgtcccacctccagccctaaggcggttttcccctgtctcagtagatggaatatacaatcgggttttacaccgagacattccattgcccagggacgagcaggacacagatgccttcctcttatctcaactgcaaagaggccttccttcctcttttactaatcctcctcagcacagaccctttatggatgtcgggctgggggacggtcaggtctttcccttcccaggaggccatatttcagactgtcacatggggagaaaccttggacaatacctggctttcctaggcagaggtccctgtggccttccgcagtgtttgtgtccctgggtacttgagattagggagtggtgatgactcttaaggagcatgctgccttcaagcatctgtttaacaaagcacatcttgcaccgcccttaatccatttaaccctgagttgacacagcacatgtttcagggagcacagggttgggggtaaggccatagattaacagcatcccaaggcagaagaatttttcttagtacagaacaaaatggagtctcttatgtctacttctctctacatagacacagaagcagcctgatctctctttcttttccccaca

SEQ ID NO: 12771 - DNA, 952 bp, Homo sapiens
aacaaagatgaattgagcattaaaggatggtagcttcttgaactacctctgtgtcagcaaaggggatatgggagttagagtttgggaactaccagcccaacctactgggctccacctgttatgtttctgcacaaggacaatgcttttagcactgaagctcccaaagacaaagcattcctttcctgacccatatacctctatcctttcattcattcatccagcatttactgagaacttaactctgtgccaagtctcagtatttctaagcagtagcaatactgagatgaaccaaatgttccatggagtttcattcaggtaaggttagtgaaaatgtgcaaatatttgtagtaggatgagaagaaatggagttgaggatctcagaagacagagtgaataaacccaagtgggaaactgtcatggaagacatgctgttttaactgggtctcgaagtatgaaaatgaataggccttgaatgcagtggttgtagaaggggtaccttctaatggtagagatggtataggaaaagagctgttgaaattatcaaagagataacaaatgggcgagagaaagaagcgttttccagttcaggaagatgagacgttatggagataggaatgaaatttatatatttatgaaaggcatgggggccgggcacagtggctcatgcctgtaatcccagcactttgggaggccaaggagggaggattacctgaggtcaggagttcaagaccagcctggctaaggtggtgaaactttgtctctactaaaaatacaaaaattagccgggtgtggtgacatgcgcctgtaattccagctactcaggaggctgaggcaggagaatcacttgaacccaggaagtggaggttgcagtgagctgagattgtgccactacactccagcctgggcaacaagagcgaaactctgtctcaaaaaaaaggaaaaagaaaaaaaa

SEQ ID NO: 12772 - DNA, 952 bp, Homo sapiens; identical to SEQ ID NO: 12771

SEQ ID NO: 12773 - DNA, 951 bp, Homo sapiens
aacaaagatgaattgagcattaaaggatggtagcttcttgaactacctctgtgtcagcaaaggggatatgggagttagagtttgggaactaccagcccaacctactgggctccacctgttatgtttctgcacaaggacaatgcttttagcactgaagctcccaaagacaaagcattcctttcctgacccatatacctctatcctttcattcattcatccagcatttactgagaacttaactctgtgccaagtctcagtatttctaagcagtagcaatactgagatgaaccaaatgttccatggagtttcattcaggtaaggttagtgaaaatgtgcaaatatttgtagtaggatgagaagaaatggagttgaggatctcagaagacagagtgaataaacccaagtgggaaactgtcatggaagacatgctgttttaactgggtctcgaagtatgaaaatgaataggccttgatgcagtggttgtagaaggggtaccttctaatggtagagatggtataggaaaagagctgttgaaattatcaaagagataacaaatgggcgagagaaagaagcgttttccagttcaggaagatgagacgttatggagataggaatgaaatttatatatttatgaaaggcatgggggccgggcacagtggctcatgcctgtaatcccagcactttgggaggccaaggagggaggattacctgaggtcaggagttcaagaccagcctggctaaggtggtgaaactttgtctctactaaaaatacaaaaattagccgggtgtggtgacatgcgcctgtaattccagctactcaggaggctgaggcaggagaatcacttgaacccaggaagtggaggttgcagtgagctgagattgtgccactacactccagcctgggcaacaagagcgaaactctgtctccaaaaaaaggaaaaagaaaaaaaa

SEQ ID NO: 12774 - DNA, 410 bp, Homo sapiens
gccagggcagaggcctgtttttgtgctacaggcccctctggcagtctattgaggccgatggtccccttctcagaataatgttttagaatacacaaaagaagatatgtaagattatagaggaaacatttcatacaagtggaattatcaaaatattaacaacaaacttttggtctagtattatatgtgcttctttattagtttaggaaaatggaaatcttttccaaaagtctgctagccaacttaccctcccatctcataatggcagatgactagttgttctttcaaaatccattctgcccattttctggggcatatagctgataagctagacactccgttttctgtacttcttgcagttaaatgtggtcatgtgactgtgctatcactaatataaaattcaatggaacatg

SEQ ID NO: 12775 - DNA, 410 bp, Homo sapiens; identical to SEQ ID NO: 12774

SEQ ID NO: 12776 - DNA, 7713 bp, Homo sapiens
agggatctgcaaagacttggagaacttcaatctgaattggcaggagtagctgatttctctgccacctatcttcgctgtcaactacttctcatcaaggttggtttgcatccattccatttatgattgtgttgctaaaaatgcatctttgtggatccagcagtgtgtgaggccataagttataaaacttatggtcttaatgcaaccacttgacaatggagaaatatgtactctgcagtgtgattacatttgtctctaattaacgaaatattaactcataggaatttgtaaatttggggagaattcttttatcataatataattagagcagattggataatcattttagttagaatcccaaggttgtaaatgttttgtataatttgattagcaaaggaattgtatgaagttttagactattttcttaaaatgctcatttgaaggccaggtgcggtggctcacacctgtaatcttagcactttggcaggccaaggcaggaggatcgcttgagctcaagagtttgagaccagcctgggcaacatagcgacacctcatctctacaagaaaatttaaagtaggcaggtgtggtggtgcattcctgtatatccagctactcggctggagttgggaggactgcttgagcctaggaggtcaaggctgcagtgagattgcactccagcctggatgacagaccaagatcctgtctttaaagaaaacaaacaaacaaacaaacaaaaaaactcactgcacttcatcaaagttaaaaggttgatttcattgcttttaaaaagaccaacttgctggcgtttcttactcagtagtcagctatacacagaattggtacccaagaatctatttagttttgctgagttaaaaaacaattaaatgagttcagtatctttcagcttctgcagcagaattttactataaattttggcacagaatttaggagagcccttctcacttgacgaacttttatcttggccctagttcaaagtgttctttgttttcaaagtgattaatgatgtttggctaaagtcagagtaaatcagggagtcaaaagttattttctactgtgtgaacttgtgctaaatgttatatttacagttgtgcaggtgtgcctatacatgtaaaggtgcgtatgtatacttggcacttaaatggtccttgttaggctagatatgttctttctaatgtatatatctgtgtaatcaccaccataggcaagtcgtagaacattttcatcactccaagaagttccttcctgcccctttgcaaggttgtttggcttttccaagcctctgtgaaaccccaggaattcaaggaggccatggagaagaatccacttttctatagtagcaaaatatgggtgaggaaagagaagtgattactcctaaaaagaacacataattgttggttattcaatgacaaggggtgacagtgtaggtgaggggcccagagccagaacccaaggcaagtgtgtttaataacaggaaaaaagctaaataaattttggtacagctacctagcagtatattctgtagtcagtaattctttatgaagaattatacaacaacatgacaaaatatttagggtgtaatgttatgtacccaaaagaaggggagccaatcataatcccaaaagatagtccagaacatcatagtcctaaactgtttaaattccaaaagactaaaatccctaaggtctaaaatcccaaaaaccacagcccagaaaatatcaaaatccccaaaatataattatggaagaaataatttaaaaaatttaaagatatttattttttaaaggggaatttatttgagaaacataaaaacacaacagaatactttatacatcacttaatataataaaacagacaataacaacatacatttttgcaagcataaacactcaggttactaatgacagttgggtgggtctaacagttatgagcagatgagccatatttataaagaaattggtcataaagggaaaggtataaatgcatatcactttggttgttaattgtgtatacccagctttttaactgtggtcatctgaaatactgtgcccaacaacctcaagtcttttgacgagattgatggaaactgtgctgggtcaccactgcatatgcagtcacccaaagagcctgagatctcaagaaattttatctttcacaaatgcagatgtacgaaaaggatatctcatttatcgaggaagtttcaacattttgtgtacacactcaatgcttatacacaaagtcagtattgtgatgatgcactttcatggagtcagatttctgatatccaagcagcagaacccagagagtccgttttgctatattgcctttttttttttttggaaaaaaagtctccgtttatcatccaggctgaatacagtggcgtgatctcggctcactgctgcaacctctgcctcttggggttcaagcaattctcctgtctcagtctcccaagtagctgggattacaggtgtgcaccaccacgcctggctaatttttgtatttttagtagagacagggttttgccatgttggtcaggctggtctccatctcctgacctcaggtcatccacccacctcggccttccaaagtgctaggattacaggcatgagccaccactcccagcccatttcgtcttaagtatttgttctctcctggccactggctgattggatggtgcccgccaacattgagggcagatagtctccacttagtacactcagatttatacactaatctcttctggaaacactctcatagacacaccctcaatgtgtaaaacaaaataatcttttaccaggtttctgatattccttaatctagtcaagctgatatctaaaattaggtccacaagtccaccccttgtcagcttggcactcatacgcatctccttaagccatatttaatttccaaataaagacaataacatggtaatagttgtgcctaacatgatacaactaacatgatgcaactatcctgcatacaacccaaaacacgctaatcacttccccagaatttggatgtgaggatttcaacatttgggattgtatgttttgggattatgatctaatccccaaacttaattctgctttctgactacaactgtcaaaaaacatgcatacaagaaatgattagaagtaaatattccagaaattcctatagtttttatctacagtttagacctaccactgtttaatttgatagccaccagatacatgggactcttgagcactcgaaaagttgttagtccaaactgagatgtgttattaagtgcaaaatacacactggatttctcagacttagtatgaagagaaaatgtaaactaattaataatttaaaaaatactgcatggtgaaatgttaatatcttggatatactgggttaaataaacttttttaaaaaattaacttagtctttgtatcttaaaattaacttacatctttgtaatttaaaaaccgtggctacgagaatatttaaaattatatatagctcatgttatatttctattggacagtgttagtctaggttttctgtaatgtcatttgattacatctgtaattcagaaggactgagaaaataagaggctgtcacagaagtttgtgcaagggatgaggtcatgtggatggataggtgaggagagagatggaaggtaaaatcatggctcttagtggtggttttgaatgtagaaagattgaaagagggagaaatctaggaaagctgcttgatttctagttgaatatgttgataaagtggttggggcttacaacataatgagcataggggaaaagaaaaaagaaccacagttaaggaagaagtatctaggtggcttgggttagtccagtagctctgggaacaaggagtgcctagagcccggaagctggcttgcctgcgcattctggtgaagctttcgtggttcctgtcctctgcttccagaagcactgatctgggacacagagcctttgggccaagaattggatcaaatgggtgggaattcatttagcccaaaccattggtctcatctttctccataatagatacagcttattgggttaaaagaataagatcaattgagaagtcctgttcatgggagactttcaaaggaaaacaaaaatgtaaatcccaaatgataggccagtctttgtgacctcggtattctgttccctcctgatttgtctgcgtaggccttgcaggaaaagttgtggaatgtagctgcccctttgtatttgaagcagagtgatttggcctcagcagcagcgaaacaggtaagcttattcagaccttcccttcaaataggtctctgtccagtaattgtctggtccaagacagagccagaggccttcctatagctctgtctgtgtaggccttgcaggaaaagttgtggcatgtagctgcccctttgtatttgaagcagagtgatttggcctcagcagcagcaacacaggtaagcttattcagaccttcccttcaaataggtctctgtccaggaattgtctggtccaaggcggagccagaggccttcctgtagctctatacctctgctgtggcctccctaatttcaggctatgacagaagttagtgatatgagaaggagcataactaggagacacagcactcactttggactcaggggacctgggtcctagtcccaggtcttcctctgatttgctgagtgatattgagcaagttacttaaattccctggattttttctcttctataaaatgtggcagttgggccgggcgcggtggctcacacctgtaatcccagcactttgggaggctgagatgggcacatcacttaaggttaggagtttgagaccggcctggccaacatggtgaaacgctgtctctactatcatgaatctttcatctgaaaatgtagcccaactcagttaaggttgtttatatctttagcctgtaccatctcttcaacgttaaaaggtcctgggtagttcattaagtaggctttaattttatttgtctctagtttatttctttttagctttgagtcattcccctttgcacctgagtattgagacttggtgatctcttgcaggtcaagtcttccagatagggagtctgtaaatgacccaggaggaagctaatgatggtgactgttattgttacattacagttcactaaatgatttcaagtctattagcttaattaaccctcataataatcccattagataggaataagtattaagtctgttttagagatgaggcagttaaggctcagcaaggttaaattcatagagctataggtaatacagtcaggacttgagaccagatcctctgatacccagaatctgttttctactacagtgctgaactcttgtctgatccagactctttctcagacctggtatgtggcttattgtagaagagtagaatttaatgactagaacccgataattgagccacattggaaggatgggaccagggagcaataatttggaaggaaaagaggaaaggaattaccattgctgtataccagatactgtgataaacacattgcatgctccatttgatacttgaaacttcatgatattggtactgtttcttccctgtttacagaaagggattgagacactcatgtaatttaacttgtcttattgccaattgtaagagagtctggagtcatttccgtgaccctagagtgttcactgggaggcaagcacagaaggaaaagagaagcatcattttgatgaaaatcgcttatttggatagaaccgagcaagatcggggacttgatctggggtcatagacaaatgttttcttgcacttatttctgtcccaaactccctcagaccaggcccatggaacagtctgtcaggataactaacatatggttaatagttcctgatgcttaattcttgaggactttgtggggattgggtttccatacataatatatattaatttgttcccacagcagagtgggcttcatttagggtaagaagcagtgctttcagtgctttgcagtttgcttagtgattaaactttcttatcttcacatcatcaactaagatgattttattaccaggtcagtcttctttttaaataggcaaaataatttattctctttttacaaggcatactatactaatttctttcaacacttaaaagcactaaggatgtaaaatctcagttaagagtttcacctaaggtcatttaacagtagaattctatgctgctctcaagtaagactatgatattcttattgatcgttaattatctttcctttatagattatggaagagacctacaaaatggaattcatgtacagtggtgtggagaataagcaggtggtgattatacatcacatgaggctgcaggccaaagctttgcaacttatagtaacagcacgaactacacgagggtaagatgtggggttggccaaaatatgtggcatgttcctttcaaagatacttcaaatgcattcagacatcacacgaaagttaatgataagtgaaatgaaatttaggaaagactagctaaggaatgtgtgatctattcatttttttcagatattacaaattctgttgttggatcagattagacccttggaaatccaattgtgtctctcccttgctaaaaaccctctggtgactctccattacatatagcacaacactggactttatctggcaataaggacactctgtatcctcctacttgatagatttccttaagaatttagtgccagggaccactttttctgttctgaagggactaataagctttttctcaggcaataaggataaattaagaggatgtactgggaagtcagactactttgttcaaatcttgtcttttctacttactagttgtttggttatgaacctttctgtaccttgtttccctgtacaaaatgaaaatgaagacagcatctacctcatggcatttctatgaagaataaatgagataatacatgtaaaaacacttagcatggtacttgatacgtaataagagctcagtgtaattatatctgtaagactttcagataactggaattgccacatttcattgattccaagatacacattttttattattgtaacttctctgaaatcagatattttgatggtgtcccatagtgttttttgtttcttactatttcataaaataaaggtgcatcttaagaatgatggcatcatagatttgatacaaaaaagtacttaggtgactcattgccagctcacagacatgtttgatgctcagtccagctcctgtgtccaaaaaaaaaaagtgccatagagatataaatatgaatgcttaaacacagaaacatactaggtcagaaataacatcctgaaaaataaaatattttatttcttcacgtatcttgatagtgacctcataaagtcaaagaatcatttaatcttaaagatattcatatgtggccgggtgtggtggctcacacctgtaatcccagcactttgggaggccaaggtgggcagatcacgaggtcaggagatcaagagcatcctggctaacatggtgaaaccctgtctctactaaaaatacataaaattagccgggcatggtggcatgcaccagtagtcccagctactcgggaggctgaggcaggagaatctttagaacctgggaggtggaggttgcagtgggccgaaatcacaccactgcactccagcctgggcgatagaacgagaatctgtctccaaaaaaaaaaaaaa

SEQ ID NO: 12777 - DNA, 280 bp, Homo sapiens
cacacctgtaatcccagcactttgggaggctgaggcgggtggatcacgaggtcaggagatcaagaacatcctggctaacacggtgaaaccccgtctccactaaacatacaaaaaattagccgggccaggtagcgggtgcctgtaatcccagctactcgggaggctgaggcaggagaatggcgtgaacctgggaggcagagcttgcagtgagccaagattgtgccactgcactccagcctgggcgatagaacgagactctgtctcaaaaaaaaaaaaaaaa

SEQ ID NO: 12778 - DNA, 6779 bp, Homo sapiens
cattctcttcaaggttcagcctggagaaggaaataaagctgctttcaatgacatgagagccttgtctggaggtgaacgttctttctccacagtgtgttttattctttccctgtggtccatcgcagaatctcctttcagatgcctggatgaatttgatgtctacatggtattgttaaattttaaattctctttttcatttttttgtttgtttgaaacatgtatttctaaaggaaggaaatctttctttagttttacccctaacaggaaagatcctgccctgactctttagtctgtgaccagtagtggggaagaactaaagaactagagttctctcccttgcttctaggcacacagtaaccctagagaccctggaggggtcctcctcttctcgcccagcatggatatccgtgccttccatcatatctgcgttttctccctcaccctctctcccagcttattttcatcaacccataaatatgttcagactttttgttttaatacaaaattataacctgttcaccaccctggctttgactcaccctagccactgtttactgttccttcatacccacacatttcagaacaatgtacagaacataagcgagcaagaacttttgaatttccagttaaaaagcataggatttgagacctacctctgacaggcaaaatatctctacttattgggtctcaatttcttcatctacaaaacaatattattaccaattcctacctctcatggttagagtgaggctcaaatggtgtctttcatacattatacttactgtggttcaggcatatagtaagttctcataaattagcaattattttcttcttcatatctcattggttgctcaatctactgtaatctggatgtagatgacactactctagcaaaacttgtttagcaaagggtataaatgagctttaatcttaccttattttttgaaggatttgacaccacagacctatcctccatcccttaaaatgtcttcttaccagctgccaccctctctttcctgggtttcctgtttttctattatttgttcttaatctgccaagctgcctcccctaattctgttgcccttaaacgtttgagatctttgtttgcttgttatagtgatgttgattttcctgaattccatatcctacttccccctacaaatatacacatatcacagtccccaaaactactacctgcgtatggacagatacctatcaactcatagcaccacatcctgacatctctcctgtactctagacccagatgccctactacctattagacatcacctggtaaaccaccaatatctgaaattcagcagccccgaggttgaaagtgccttcatctcaaagcctctttcttttcctgaattccctaccttttttaatgcaaactgtcatttccagcgcagtcacctacctttgacatctgtgatttacctttgattcttccttgttcaagtctgacctctgtccgcttctcctttaagaccgctctttggtctctgccctcttctcctttctcactgatattcttcctctcatccccttatcttcgcctcatacctgtggtgatagcctcttctccggactcccaggcttgcatgtggctccttcttcggtccgtcctccaccattttggcaggtttacatttctacagttgatctgatggtggtcattcacctatgtaaaaccctttggaggttattatatatggaataaatgtttaattctgtagggtagctttgagacccttcatgatatcgtacctgcctgcttttttcagctgttctaagctatttgtaattctccaaacatggtgcctctgcctggtatgccctccttaatcacatgtcactctactcatctttcaggacattgttcaaatgccacttttatgagacttctgtgaccaccataccctatcaggcaggatgaggaacttctcagaacttcctttgcaccaccttacatcaactcataatatatattacttttatacttttatttaagataaaaatataaaaatgctttatattattatataatattttatactgttttttattctgttgcagttgcccatttttatatctgaatcccctaccagattgtaaccattttgaggttatcagctatgtctgagatgtttatgtctcctaatgcctagtctataatgaccgtttagtaagtgtgtattcgtgaatcagaatttatacctgtgagtgctgtataatagttcagtgtcaatttttttctatgatactattgctgaaaatgggttagatattcctccaagaattgtcttcagagctaatcacgagtcatagaagatgattattctttccatgcagtgtttttgtccagaatggtgctgtgcagtcttatcactcatcttgtatgtcagatttaattctaagcagctcctttctctttcagaaacttagagcttcttaatcagagtggcactttgccccaatgaaattattcagaagaatgtatccaagttctgtgagctaatccaaggaaaacaaatttttttttggtactttggcagttttgttataaaataataggcctctcacagcagatatgcctgatggaattgttataatcagagccattgagcaatatagccaggatgtgtatcccattttgactccacagcccttgttctaaatcaccatgctgtattgccacatacagttttattttttatttatttacttatttttttcaggacacagtctcgttctgttacccaggctggagtgcagtggcgtgatttcagctcactgcgacctccgcctcctggattcaattgatccttgtgactcagccacctgagtagctgggattacaggtgtgcaccaccatgcccggctaatttttgtattttttgtagagactgggttttgccatattggccaggctgatctcgagctcctggcctcaagtgatccacctgcctcaatctcccaaagtgctgggattaaaggcatgagctgctgcgcccggcaccacatatagtattaaattaagacctttaaaatatacatgttcatatgtcaatgatttcaacttttaggaattttcaagggaattgaggaacactttgattttcttttactgttacttaactcagaaaatgtagccacaggtctagaccatttaatcccaaaacctattataacgaagcattattctttgtctataccctgatgtgctatttaacttatttaaagatataattgagaaattggtctgtaagttcaaattggtttatattgtacaaatggtagaggtaatggggagaggcagactttttaaaacttaacctttatcattgagggaaaatttgagagacttaatgaatttgagactagccacttttgttaccattaccctgactcattaaccattactgtacaaattagatttattctctaacatttagttgtgtcaggagaatattttctgattatttcaattgctacacgtatttgagggagggggctgtgtatacaaatattttgactatagaaattacctgaaagacatatttattcagttattgtccccgaagagtttctcttttttcccttagagatgggctttcactctgtcattcaggctagagtacaatggtgcgatcatagcttactatacccttgagttcctgggctcaagtgatcctcctgcctcggcctcccgagtagctaggatgacaggcatgcaccaccatgcccaactttttttttttttttggtagagacagggtctcgctattatacacaggctggtctggaactcctgacctccaattgatcctgtgacctcccacctctcaaagcattgggattacaaacatgagccactgcacccagccaattttctcctaatagtttctggtatttcttttccagtataatagatttcttggacatcatagataatgtaatgactgatccctggatgaaaatccaggagcttgtatcagcccacagaatgctgcttttacagaaatgtgacttacacaatagcaatcctaacttttgcctttgtttttcaggatatggttaataggagaattgccatggacttgatactgaagatggcagattcccagcgttttagacagtttatcttgctcacacctcaaagcatgaggtaactttttaaaactttctagatacatatcaagtatataaaagggggaaagaaatcttttacaattttaatttttaaaatacaaatacatacaagaccaatgaaaataaaaattagctcccctactggttcaggagatttgggatgtttttctctttttgagatatttaaaattttacttgtattacttccctttcataactgaagcaagttgttactattctgttttgagtctgcttctttgtagttatcatgacaaactaaagtaatataattttagtaattctgtttggactaaaatgatttatgatttccctaatcttgcctcttttctcttggtgacttacaaatgtcaatctttctaaacaaagagctctactctgctgtcagtcagtatttattgggtgcctacaattgtcaagcactatgtcacttagagttaatattctgtctctaaagtggccatgtgattatatggggatctaaatttgtgattgggaatatccaggtaactccttccttgctagacaataacagaaatttaaaatagttgatatataaatctctttcattttcttttcctccaaactgaaaacccatgggatctagcaggaattaatttttaaaatggaaaacaaattatttccttattgcaaatgatgtttctcctagaactctagatattagatatatcccagataaaagccaaatatttagctttatattttcatgaggtaatattagaattttttttaattggtaaaaggtttcttggaaatttgagtaattgattttgcttcttctagttcacttccatccagtaaactgataagaattctccgaatgtctgatcctgaaagaggacaaactacattgcctttcagacctgtgactcaagaagaagatgatgaccaaaggtgatttgtaacttaacatgccttgtcctgatgttgaaggatttgtgaagggaaaaaaaattctggactctttgatataataaaatgagactggaggcattctgaaatgaaagaaactcctttatatatccaaccacaatcaaacatataaataagcctggaaaaccaactacaacctgcaatttaagattactattactttaagaaaatcaatttcatagtattggttttaaatctttttaagtttttttaatacgatctatttttataggttctttttcagaagtaaaattttgtacatatatacatgtacatatctgtttagtttgggttcatttctataacattttgtaagaaaataaaagtttgagcacctgattatatttagttttgcttttccagatattacattctatagttaccaaaaatggttgaagggagggatttctcattgcagagggtggggtgcaagggaataagacacttgtacggaacactgaagctttgccaacttctacacatgccttttttgcagtcctttaactgtccaccctaccaagagcttataaccagtatcagaactggataatgacgcagtttttcactctgacctccatcatgcttgcctgatttaaaagccctcagtttgcagtccagggactgttcaggcttgtcctcagctgagaggacacaggctagagggactgtgcagaaccaggctgggagaagggctgggaaaactgggagtggagggtggatcctcatggagcaggagagtagctcatggctccaggagcctgaggccatgcagttgatggtgagctgacatcaattctaagactcatcctaattgaggggtgttaaaaagtgtgctgcttagaatgaccaaatatagttattgtaaaaaatgatatttatgaactttttattttagaaaacatgaattttattgctccctgtattatttgtttgatactaggattcatgctaaactttttaagaatgtattggatatcaagaagcattccttacattagtagcaataaatattagaataaatatgaaattgaactattttcagaaaaagggcagtatattaagagcagggactgttctctagttattgaggaaaactggactttgtttgtgtttttggtggaggaagaagtttaagatactttagtcttaaattgaggtttgccaaatgagaagttcaaaaacttgggctttctaatcagaatttccaggaggaggaaagtgtgtgctgaatattttaaacatttcccactgatcatacaaagtctgatttttaaatttacacttataatgcctttgtattaaaattatttttaacatgtgcttttccaaattaaaaatgaagtagagtataccaaatgcataaactttcattagctaaggaactcatgtctgaattttgttgtagttttgaatgttgtgctctttcatacagaatgggaaacataatcctcaggtatcccagcatctcttgttgaattgaagattattcattgctttggcctcacaaagttttgatttcaactatcataagtgaaaatatcttcctttaatgttctaagtagtgataatattactagaatgaaagaataaaaagaaattgttcttttaaaatatgtgtaacttctaaaaataaaacttaaaatttatatgta

SEQ ID NO: 12779 - DNA, 34242 bp, Homo sapiens
ccggcagctacgcgacctgtgaccatggtggctgtgctgggcggccggggcgtgttgcgcctgcggctgcttctctcagcgctgaagcccgggatccacgtcccacgggccggacccgcggccgcgttcgggtaatggcggccacctcgccccggggatccccagcatcggcgcgctcgaggggcggcgggaggggcgcgtgccgacagcaggagttcccggcgcgcgggcacggggcgtgggcgcggcctggctgccctgtcgccctttgtgccgcgagaccccgatcctgggggccagccgcgcttggtgctcgagcccctcgatcgtgcatgcgcctcggtcagcctcagttcaaggagtctggagccgtggaggcttgggctatagagtgcagccccttcagtgtgcagaccagagagacccagggagatacatttgcctgtagtatggactcacccgtgacggagcacggactagaatcccaacgccctcattagtccattgctctgtccagagtccacactaagggcataaggacaataatctcttctttctcttatgtcagaaatcagcctgagcctgagtaccgctaaggctttaatcacgggtcccgagagccctaagtcttctctttgcttgctgatctcgtaccttaatgtgcaaaagaatcacgttgggaactgaaaattcagaatcctgggcctcactcccagaggatctgatctacatgtgtggagatgcccaggaatctgctttattctcttttgtcctcccacctgtccccccatttcaggtaaaacaataacaaaaaaactggattaatttctgaccttctgtcttgaaaatggatactcttggtcccaagagatactgggcagaaatgtggatagagcggcatgaagcttgttttactttattctctacatacatccctacacacatgcaaacacacgtatacaacgaacgtacacagtgcatgtgcgcagttgactgttgatgggctactttcataaagtcagtactagataggtacacagcgtttagaactgtacttgatccaacatagaaacttttagtttgaaaacttgatttagaaggagaaaagagggcaaatctgaccagcttttaaaatttcatattgcaattgactagctcctttaattttagaattattataagatggtcagggctattttgatagatggaaaaacatgttaatggctacagctgtataaattaacagtgaaaatgattattttttccagtttcctgtctgcagaaaggcatcgaaataagttactgtgattgtaccaatatagttctttttttttttgagactgactctcgctcttttgcccatgctggagtgcagtgttgtgatctcgctcactgcaacctctgcctcccaggtttaagcgattctcgtggcctcagcctcccgagtagctgggattacaggtacctgccaccatgcccggctaatttttgtgtttttagtagagatggggtttcaccatgttggccaagctgatctcgaactcttgacctcaaatgatccacctgcctcagcctcccaaagtgctgggattacaggcgtgagccaccgctctcggcctaccagtatagttctgataggttatttaatggttgaggaaggccccatccatctagttgcattgcagatcattcttcctaaaatatctctgaagaaacaggtttttctggattttgtacggccgttttataaatgcagctgcaagttgatatgacatataatctgggaaaacaagcagtggtattagttaatcctgaaatgcagctgtagctcagtgtcagtaggtaaaaggattcgtgtaaaaactttgcttcagaatagccagtgcccaacctacaactgacttttgttccaaaaacttgtttgtaagtctgctgtttggaactttgacccttatttcaaaatccgtaaggtgatttattcctgggtcaggtcaagaaaagccttttctacctgaaattggatattatgtgcagttataaatattaataattcacataacctaacaatcttcctaaaaaatattttccaagttcaaccttgggatgccctgccagagaatcagagactgtccttctgctgacgcttgccaccacgctgtatctggcagtcagagtgtggccccggtgcctgagccctcttaggactctgttcagccatgaggttagagaggaatcatggcctctggagttctaatggccccgtggccacttcctagctctgtgagtgtgggcagattgttcaacctctctgagcctcctgccttgcagcgtttttgtgaggatttgaaacaataaatgtaaaagcctggggatataataaacatgaagtaattagtaggcacaatgggaatatttatataatagtacaatatataagagatgtaaaaataattcatcaagattcatgcaaatttcaagccctgaaggtagcaaatactttattgtagataatggctacttcacaaaacatacacaaaagaaatagctgaacatacaatatgataatagcagtttctttttttttttttttttttttttttttgagacggagtctctctctgtcaccaggctggagtgcagtggcacgatctcggctcactgtaatcttcacctcccaggttccagcgattcccctgcctcagccttctgagtagctgggattacaggtgtgcaccaccatgccgggctaatttttttgtgtgtattttagtagagatggcgttccaccatgttgggcaggatggtcttgatctcctgacctcgtgatcctgacctcgtgatccacccacctgggccgcccaaagtatcgggattacaggtgtgagccaccacacctggccgatcctaagctatcttaactgtagaaatgaatttctcagaggaatagggcagtaatcataataagtaaatggcagagtcagtattgccattgcttggtggcttcattgatgcccctttaataatatttctgtagataaggagcttatagtttagtcagaccttattactacccaattctgtcttttatttttccagaaatggtatgttaagagtagatgtacctgtattcaacacatctgtttccacgtttgtttcttttttacttgagactggcaaataagattaaaccaaaagataaaacaggacctcattttttcaaaagggctgtgtttcagttatcctttgactaagggcagaggtaggagtagagagtatgtagaagaaaaaggagatgggccgggcctgtaatcccagcgcttagggaggctgaggcaggcagatcacgaggtcaggagattgagaccatcctggctaacagggtgaaaccccgtctctactaaaaatacaaaaaaattagccgggcgtggtggcgggtgcctgtagtcccagctacttgggaggctgaggcaggagaatggtgtgaacccgggaggtggaacttgcagtgagccgagatggcgccactgcactccagcctgggcgacagagtgagactccatctcaaaaaataaataaataaaaataaaaataaaaggagatggtggttgatttcattgtattggcactccaccaggagaagagagcgcctccttctggcatctgtcctggcttgccatcatgtccctcctgtgcttcactcagtcatctgtctgataagctgtgggaaggctgatggagcctggtcctggtgcaggggccgtctgtgtgccccactggtatatatcccaggacagtctggctgtcctcgaagagcagctgaggagaggttaatcagaacacctgtacggcacccataattcaggcagcacagacactggcattatgcctgtcctgaggcgttgtcctgtgctaagtgtggtccagttagatgctggatcctaggaggtcttaggccaaggcgggtgagtggcaggaaggagggctcttgagatggaggcttatggacagggctacttagcagttgacacagacatattttaacatcttaaaaaacagtaggatttatccgtgcagatgggcactgttgactatggccctcctgcagcaggccagacaacacaggataccctacagctaaagaacagcctggagatcgagaccttgggaccagtctcatctttgggaatgtcaccaaggctgctgaaggtctgggtaggtcctctgggcctgctgagtgcagacgagtgactccagggtctctgcccctgatgtccaccctcgtttcacgccagcctgcacttgaggacccttggcttccagctcaccggcgtgtgccatgagcctctgtggccattgattgagcaagccgcctagggtttttgtagggtgagccccaggctgggcacaatagcgtattcaagcatgagggcacagttcagatcggcagtctagtaaagaaaattcaaactcatgtcactgttcagaattggaaaaatcgaaataacccaaggagactgagaggcgttctggaggcgactcattcatatacaaagacagttttatcatattaaattcgtgctgttaaatgattttcctctgggggtggatttttaaacatttttcaaattttattttttaattgacataagtgtacctgtttatggggtagatagtgatgtttcgatagatacaaggtgtagtgatcagatcagtgtaattagcatatccatcgtctcaaacatttatcatgtctttgtgttgggaacattcagtatcttccttctagctattttaaactatcgcttattgttagccgtagtcatcctacagcgcgtagaacactaacacttattcctcctgtctagctggaattttgaatcaactaagaaatcttcccatctcccctttccccctgtggggatgtgttttttctcttctagcacctcggtaacctctgccaaagtggctgtgaatggcgttcagctgcattaccagcagactggagagggagatcacgcagtcctgctacttcctgggatgttaggtctgggtactttttaatggaatgtttttgcatgctgtaaaatctatgatgcattcacaatactagatgccaaatactgatgattaattttagtgcttttttgaaatgttttcatatttgctacaatcaaacttaaatgacttagaaaagtaggtaactttctactgctgttcagaattggattttttattcctttagtaaagtacccagtttttcctattgcaagtactctgtgaaatcacagttgcccataatttgggagggtgacaggggtcaaggaaaggggtgtgggaagaaggtaaaggaggaacgtgagtgggtaatcagtcatcctagtttgcttggcgttgggggattttccaggatgtgggactttcagtgctaaaactagagtgaattgatcacttgttgtggttgataatatattccgttaaaataagaggtaagaaaaaaaaaacctcagtttgattctttttagaaatcagagttagattggcatattaccctctctcaatatatgggccataataaagcctactggatctcaatctcattttgcagaactggagttcagatgtagaaagttcaagggaaaaatttgcagtgattccagtacatccgaaatctggttttaagggtgttagtattgttgctttatttttgatttagttaaataatcctaatatttaatctcagtattcctgggggactggatccaggaagccctcagatcccaaaatctgaggatcctcaagtccctgatataaaatagctcaatgtttgcatggaagctacgcatgttctcctgtatactttaagtcatgtctagattacttaccatatctcatgcaatgtaaatgctgtgcaaataattgttattttgtattgtttagggaataatgacaaggaaaaacgtctgtacatgttcagtacagacccaaccacccatttttttcccgaaatatttttgttccgaggttggttgaatccacagatgtagaaccacggataggaaggctgactgtacttatttctttgtgatttgcttctttctaaaagtgaagtgctaaaaaggttccacttgactgagcctcagcggatcgtggcactgttgcacgtgtgtctaaatggtgtttggtacctttgttttccttaacctgatgaacaaggacactgactctcatggctgatggggagctaaagttatctgtaaaaacattgcctatcttagctttccattatttcggtattgcagtcattgtccaggtgctaaaaacttaccaatttaatttttttttttttttttgagagggagtctcactgttgcccaggctggagccagtggcactatcttggttcaccacaacctctacctcccaggttcaagcgattctcctgcctcagcctcctgagtagctgggattacaggtgtgcaccaccatgcctggctaattttgtatttttagtagagacgagatttcaccatgttgtccaggctggtctcaaactgctgacctcaggtgatctactcgccccggcctcccaaaatgctgggattacaggcatgagccacagcacctgtccccaatttaatttttttttatgtaaagtattagcatgattccaatattaaaaaaaatggaccagaggagattctctctcctgtcctatcctcagcacccagttcccctccccacaggcctctcagatgttacatgctgataactatgtacatgtattccttaaatgtttttttaagttttatattcttggcactggtcttcaaatgtgtacatgtgtgccagggagcaaatgccttcttgtttctgaaattggtcttttagactgttcttttttcccatcttctcacctcctgcccctccttcagggtacttccgtggccagaacccctccaggtcagaggcagaagagaagcctcatgggtcacagcagcagatgtgggctggagatctattcatttggttttggcttgaattttctgaatggtttacttgatcttgggaaagatatatcttgccaggaaaaatgataggccttgacaatgttgaatgatcctgcaccaccttgaaagacattttctaatatggtttgtcaggcaaagtggttagtagtcatttgtggcctgaggtagaagtcctcagaaatcagcagacttcactgataaaatgctgacttgcccctggactgggctctgtgagagtggccttctgcactgtgcacagtaggtgtgaacacaccacacctacagggaccacgtggtgggctgtggactagcggccaagctccctgcaggcccactaatagaattcagcttttagcatgggctgtttcatactgttctgatgaaactgatttggtttctttcctccataccccttctgcatttcagtgtttttgtttagttttcctggtttttaattataactacaaaataaaatctttaggctattcaccttagcttagtaaaaaaaaaaaaaattaaaaatctggaattttagaattctactttgaataacttggaccaaatctcataaatttctttgcagatattatagagatccctctcatgtgtaagtcattgttttaagaagaatagataacccagaagcatatctgtgaattaatttgtatacagtttcattaattctttcctttagaaaaggaagattaagccaaagaggtttcaaaagtgctgaaataatacagaagcaaaggaagacccagggcctctgtctttctcaaaatagccaccagggggaggtcggaggcaggcctgcactccgccgggaaaggaagcgcgcctcctttttttttttttttggtggagggacagagtcgcactttgtcaccagggtagagtgcagtggcgcaatctccgttcactgcaacctctgcttccctggttcaagcgatccgcccgccttggcctcccaaagtgctgggattacaggcgtgagccaccgcgcccggccccttttttttttttttttggagactgagtcttgccctgtgctcaggctggagtgcaatggcgcgatctgggctcactgcaacctccgcctcccgggttcaagcaattctcctgcctcagcctcctgagtagctgggactacaggcgcacaccgccatgcccggctacattttttttttttttttttttttgtattttagtagagatggggtttcaccgtgttgcccaggccggtctcgaactcctgagctcaggcagtccgcccgcctcggcctcccaaagtgctaggattacaggcgcacccggtcagcctgcctcctttcttcgagtggatggattaagtcattgcaaggctgctttcctgattacattctgaccactttgagtagaaactactttgcttttaagattgttattgcttctgttttcactgtaatgtgtttgatagtgaaagcgatcacctgagggtaaccaagtggctgtttttaggaagtggagagactgattttggacctcagctcaagaacctcaataagaagctcttcacggtggtcgcctgggatcctcgaggctatggacattccaggcccccagatcgcgatttcccagcagacttttttgaaagggatgcaaaagatgctgttgatttgatgaaggtaggtctctgagggaagggccaggggaggaagggtggctgggcctgtcttcatttattttgtttaaattttgttgttatatttttctacaaaataataccatgtgattgctatagaaaaccccaagagttcaaataggtataaagaagaaagtagaaatagcccacagtccagctctctagagacactaccaaatcttggcggctctgctttctggccagtcttattacatcacaaacgcagtttcatattgatggcatcgtgctacacctaacgtttttctaacttactatttttgttgaacaatttttcaaggaaataactttcatgtcaataaatatgcatttatactagttgtatgataggcacatattattccattgtatggatgtactgtatcttatttcaccaattttctttttttttttttgagacagagtgttgctctgtcacccaggctggagtgcggtggcgcaatcttggctcactgcaacctctgcctcccgggttcaaacgattctcctgcctcagcctcctgagtagctgggattacaggcacatgccactatgcccagctaatttttgtatttttagtagagacagggtttcatcgcattagtccggatggtctcgatctcctgacctcatgatccacccaccttggcctcccaaagtgctgggattacaggcatgagccaccacacctggcctatttcaccagttttctaatagtagataattaacttaatttttaagttgcctttttctgctgttataaatagcaggcagtgaacattctgttgctcgtgggcattttcatttttttgccactataaacagtattgttgtggacatcctggactgagctcctggcacacagggagaatttcatacacatttaggagacaatttgctaggtgatggaagttccagatgttcattttgcaggatagtgccacagtagttacaccattttatggtccgggcagcaaatatcttggagtaatattaattctttacctttaattttccagtcattccattcttttttcttggcggcctctctaagatgtaatctttgtccattttccctgccaaacgcatgtccagaccctctctgattcacccgcggactcacacaacctccccatgacgctgttctctgacagcctggctcttgccagttcttcccacagttgctttaccagataccctgcttcactccatccagcagagctcagggtcccctctctgatctacagaactgttctcaaggtccttgctcaggcatgcatatgcacacacgtgcacacgcatacacacgtatgctgtatttgtcatatttaagtacttggtctccattgattctagttccttgagctttttatccaaccagaagatgtagttccctcctaattcaaacccataccgtatgctcaggtttttgtgacaatttccactaaaagtaattaagagaaaacatgatgtcatcaaatggtggactctagggtttttcttttctgactaattgatactccagcctcacacctgtattgattctgataattagtgattcagtttcttttaacagagaggagcaataacccgtgccgtgcattttgtcgtatgatcataggcgctgaagtttaagaaggtttctctgctggggtggagtgatgggggcataaccgcactcattgctgctgcaaaatatccatcttacatccacaagatggtgatctggggcgccaacgcctacgtcactgacgaagacagcatgatatatgagggtaggttctgcgaaggggagatgccgggacggcagatccttcccctctctccgcatctcatctcttattgtgggatatgttgacaagacacatctctcgtgcttctagttctcaactctcaggtaggaagaataacgagttctcagaaaagtaatgcagtttaaccagtctgagttttaaagctttctgtttccaggagtgaaacttccatggctcaggaaaaggctaagtaaaatcactatttctatttactactactgataatgaacttcagggaaggagggggtggtgtgaagtgttattaataatctcatttaaaatactgtgaggccaggcacagtggctcatgcctgtaatcccagcactttgggagctcaaggcagaaggatcgcttgagcccaggaggtcgaggctgcagtgagccatgattgtgccactgcacttttgcctgggtgacaggagtgagagagagatgggggaggaaagaaaataatgttgagtgtggaaaagaatcactggatacaaatatgaaaccttttattttgattaaaagaatttctgtgctatttgcatgctttaacgttgtccttcaagcctgtctttgaggttttttttttttttttttgagtttgagtttcactcttgttgcctgggctggagtgcagtcgtgcgatctcagctcaccacaacctcttcctcctggattcaagcgattctcctgcctcaccctcccaagtagctgggattacaggcatgtgccaccatgcctggctaattttgtgttttttagtaaagacggggtttctccatgttggtcaggctggtttcgaattcccgacctcaggtgatccacctgccttggcctcccaaagtgctgggattaccagcgtgagcccccacgcccagcctgaggtctttacaggcactggaataggggccagtgaacttcagcctgtgcattacacctagcctgcctcccacttttgtgcagcccacgtaccaatcgaggtggctagtgctgtgagtcacagagaccaagctggggtgtccctttaccacccagcattgctgccccagacctgcactggtggtcactacacaggggtgactgttggcaatgagcaggcacccagccatggaatttcagtcagcaactcaggagttgcttagcctccagcaagctgccccattgagatgaccaggctcttgggaggaaagaagggtgcaccaggatctaggggttgctaggacaagaagtgaaactgacctgcgttaccctactacccccacctgccagcctggcccaccaggaccctcttcctcaggccactagctttttgtccaagtgtgagtctagtggatcccagatggcctgccccagacacttaggactaggtgggtcaggtgttttctctcctcatgtgtaagtatctacataatgtctttgattttgcttcttggccagcaaaacctaaaatatttatttactctctggccctttacataaaaggtgtacagatctcttcgctagaatatcacaagtctagtctttttcagctattcgacaattcacgtgacttttaagtacgctacttagtggcagcgttctgttgtagaattgtagttcttcacagtctttctgttttttaaatgaatatgaagctcttacggtgagtctgatgtggttgccagtcctgtctgtgctcctgcttgtccttattttgctcctgcctggtatccatcttgtgcacagtaggccattccgctctgtgaagggtctgtcccctcccgcggcctctaggacaggctgccttgagttcttcctccctctcctgtatccttaaattctctccactgggtcagtcctctcagcctgcaaaagtgggcacaattcttcctccagaaagttgccactcctacctgtggttactatcttcccattctttattctttcccacaaacttatggaaagagccacctgcattccctgcttctagggatcctcctttccttccttctttagtccattctgccccatctccctctctggcccattctagccccctctactgaaactctcctcactgacccctgcccacttgttctttcccataatcactatctcagttcatggcctgcagatgacccggcatccaggcagagtcccagatgcatccctcgagggcccagtcctcctctgccctcttcatttgcccaccttgccctgttcattgaactgtgatgctttctgttgttacataatacccctccagttatcctcacctctcttctttccccacattctcctggtttaggccgctagcttcatatggtagtttgttctccataggagagtttcctttgtaaggcaaaaatctaatcacttaattccactagaggacttaaaatccttcactaaccagcaaagtccgtgcagtttggctggcccctcctgccagcccctccccggacattctcccatctcccctttctcctcatccttccggtgcctctcccacgtgggataaatggccattcctggaacaagcttccccctcatgcctcttcgcctttgcaactgctgctgtgccagcttgcaccagccttcccctcagccacatcctctgccagggcatattcacccctgacacagctccttgggcctccgcgtctgggatggcgtcccggagccctgagacctggcggtgctctccctcctggaccccgccacaccttgcacgtgcctgtgtcacggcccttcaaccccgggcactgtcagcacttactcccttgcctcggtcaccgcagtgggaactcactgtgtgcagttgctctgactttcctttcttgatgaaagcaagagtctctcagtagcgcagcactctttactctctgacgtctcgctacttcccctcctggctactctttctttttcatcccccatcctctcctaacttgtgtcaagatggctgtggcccgccagtgtgctagagaccaagcccccaccacgcacctcctcttggctccttggtcattctgcagcgtttgagaacatgctcatgatgtgtgcgccattggttacacccctcttcttgaagctttctctgtctggaagttcttgccaccgtgttctcccgacttccctcctctctcaggctgttccctggctgacacgtgcctgctcccccatgtgggccacagtgttggggtcctccaggcgtcaccctcagtgctctgctcccctcttaccctcacacctcacacctgagtagcttcactcagctccttgctccacctaactcccaaaccccacatgttcgactgttgtttttttttaagagacaaattctcactgggtgtggtggctcacacctgtaatcccagcactttgggaggctgaggcaggaggatcacttgagcccaggagttcaagaccagcctgggcaacgtagcaagaccccgtgtctacaaaaaaatacaaaacgtagtcaggtgtggtggcatgtgcctgtagtcccagccatttgggaggctgaggtggaggatcacctgagccggggaggttgaggctgccgtgatctgtgattacaccactgcactgtagcttgggtgacagaggcgagaccctgtcccaacaacagcaacaacaacaaccaaaagaaaaaaacagaaagaaaagaaaaagacgagttctcactatgttgccttattcaactttttattcaattttcttatctggttgtctcacacctactttaaattcagtctgtctaatactgaattcatgatcttctctctaggcctgtcccttctgctaaatttcttgtcattataaataatactctttctccctgaaaataatattttaattactatttattgagtgcctgccgtgagctaaagtctttaacaacgtgatatccatgtaaggtctctgattctcagcctgcttgtcaagtgaaaaacgggggctcacaaaagtgaggaaaccttccagaccacatcccccacactgcggcctgcagctcactgcactcttctcttctgctgggctctgagtggccccatcttgccctacccctctctccctcccaccaggctcccgccagcctcgttggtcccgtctgggctgattctgtgcctctccaaccggtccaggtccttgcctcctaccagtctgccttccatgatgctctgatagcaattcagcaatatgtgaatctcatggtgtcttactttaagccttccaggactccccacaactttcctgataaagttcaggctccttcactttgctcacggaatgagtggcccggcctctgcctctccaggtcccctccccccactttcccctcccaaccaccagtgtccagccatccgagaccacctgggtccctgcagcaggtggcgggctcctgcctccttgtgtgggcccttcccgctcccttcccactccttcacttgtttgctgacttctcttctcccagaatggcccaagcattccatcttctaggaagccctcaccgccgccaccccgtgtccactgcccgtgtgagcacacaggccactctgctacagatggacggctggttcttgtacccgtctcctggggtgtaggagcaacagtatctctctagggtctaagtccatgagtgaaattgctgagtgttgtgggcaggtagactacattacaagtgacagattattttccagcaaaataaatttacacttccaccagcaatagatgagattcttaacttttagctcttcaacaaaaacttgaaattctcagacttcttaattcactagccaatcaaatgggtgtaagatattatcttattggggtcttaatttgcatttcgtattactaataagattgaaaatctgtgtttatccaccatttgagtttcttctgtattatatccatgtatttttattggtgaaaagttttttgttatgtaataattgatacacacaatacagtatgtttgggtatacagtatgaaatgtaacaacaaaacgaccccgccgctgtccacccaactcagcaccagaacagtttcaatgttatcccagtgttactctaatcctagtcagtaaccccttttagggtaactgtgttgcaagcacctcttcacagtgggtggcttttgcctttttctttatgggcagaactacttaatgtaaggaaatgccacagtgttttgtttttctttcctttttctttttcttttctttccttttttttttttttttttgagacagggtctccactattgcccaggctggagtgcagtggcaccatctcagctcactgcagcctgcttgctcaacatcaaactatccttctgcctcagcctcccaagtagctggcactacaggcgtgtgccaccgcacctggctaattttttttttttttttttttgagacggagtctcgctctgtcacccaggctgcgcagtggcgtgatctcggctcactgcaaactccgcctcctgtgttcacgccattctcctgcctcaacctcccgagtagctgggaatacaggcgcctgccaccacgcccggctatttttttgtatttttagtagagacggggtttcaccgtgttatccaggatggtctcgatctcctgacctcgtgatccgcctgcctcggcctcccaaagtgctgggattacaggcatgaaccaccgcgcctggccaatttttgtattttttgtagagacggggttccgccacattgcccaggctggtcttgaactcctggacttaagtaatccacccacctcaaccttccgaagtgctgggattacaggtgtgagccaccatgccgcccggcctcacaatgttttattttctcattggtttggctggttttgtttgattttagatccaccaacatgtttgcccatttgtttactcacctgttctttcttctcaaatgttccttctaaaagcatttatcttctcttcttcctgaagttatttttagaagttatttaagggcagcctgttaatggtcaactcagtttttaccaacaagtgtcttttctttcatccaccttttctgtaagtctgtttagctgagtgtggaaatggaagtggaaaatcattgtctcccccattctgcagtcttctgccttccatccttgctgttgagaagtttcctgtccgtctacgtggttcctgcttcggagtgatgtgtcttaactctctggctgtttttcagattttctccttacctttgatatattgctgttttaatatattctgtccaaatgcagatttcattttacttgtcctgtttggaatacattgcgtttttgtttatggattctttgattcattctgaaaaactctcccacccattatttcttcaaataggcatctcgttcattcttattctcttcttctgagacgagcggacttttgtaaacctcgtctttccatcttccttatctcttctgcatcgtcgtgtctctctgcgtggtgttctgcataatttcttaagatttgtcttccaattttctagtttttttattaactttataaaaatcctgtttgttttgtgacctttggttaggagctaatatttactcactcttaatctgaaaataaacaaagcagtgagcataaatcgagagcgctttccttccgggaagatttgcatttgttgctcttgggaaccacaggatcataccaggttggggccatttttagctcagcttgatccaggagtctcaggttgggccccggcctgcctgcgaacactgcgtctccacccagagcaggcctgcctttggagctggcttacttcctttgctgtattttcagggttctgtttctcatgtgcagacacactcatacacactcacaccccggtttccattaaccactgcaacttcagcaatgccacagaattctgttttgtgaaagatctagttattcccctgcaagaaggcctttcagagggtatggtctgccatacggccaaaagtagaagcatgtgcagggacgttttgctagccatcttcacactgtcttgcttgcttctctctcccttaccctccgcccccaaatgttttcttcttcctacatcttctccccacctcttcaggctgtctccacgtacctcattcaagtcttttcattcttgtgcagagcagttcatcctcttcagcctttatcttcagctcacacggggcctacctctgaatatttaagccagtcagcagaagcaaaggcaggcaccaggcactgtcctgtaatgggggatccgccctcctcagaaggcagttgtgattgtaaatagcagtttttcctccatttggtgatttgaattcactaagcacacagtgagtgcctgccaggtgcctgacgttgtccgggactctgtagagattgttgctcatgtgagttcatgccattagtgttatatttcttccatgtgtaacgtgtagctctcaggaagcaatatttaatatgctcaagagcattagaatctttacttatcacagtgtatttaaagaaatatagaaaacattggcctaaggaattgcatttgttgattcatgttaatggttgtttttagctattcttccctactagtgaatcatctataatacagtttgaagtttggtacttagccttttacacccatatttcttcggtagcagaaattagaatgaataatttgtgtgcatttttcaatgtccatacaaatgcaatgcagaaaaaaactcctcttttgcaaacattgtcgctcttcctcaggtgaccctgttagggtcatattttcttttatcttgtatctttaaaggaaagcggtaagtgcagctctaatttcatccacttggtaagcattgatttgtgggcctgtattgtgggaggcactagtgtaggccctggggtacagtggggagcaaagcaaagtcccttacactgcacacaggtcctagtgggaggcaggcactcagccctgggtccagaaggcaccgcaaagcagcaaccagggctaagccgagcagagggagggagggaggcattccaggcagacgagacagtgagcgcatgggctcagaagtggctcttgctcagaatacttaaagacaatactttagtatgaaattaaacctttcttcgcctacacttctgtttttcaggcatccgagatgtttccaaatggagtgagagaacaagaaagcctctagaagccctctatgggtatgactactttgccagaacctgtgaaaagtgggtggatggcataagacagtttaaacatctcccagatggtaggttactgggcttgaagggctctctgcctgttatagagggtgctcgagttcctccccagtgttctggaattgctcagtgattcatgaatctgcccatcgccctcacacgctcatgtgtgagcagaacagagaatactagttcttgtgtactgtgccagttcttgggcagtcaatctggcttaacggagaggtaggactgcgtgtccaaaggttcacattgttgagtctttaatagcagactgctcttttttccttctaatccttggtgtgtgtgcgatgacaaaataattatccagaagccttaaaccgtttctattttctaattccagaatgagtaattcgaaaataaataggccacaatgtgtacaatattttttcctttttacacatttagatgtgtctccccacgaggacactgttaatctttaatctcaacggaattaatatgaggaagaaaatattctgttttttccatcttcagaactaagtgatatgactgtaaccatgaacaatgcacaaatgtctcctattcttttttttttagatggagtctcactctgtcaccaggctggaatgcaatggcatgatctcagctcactgcaatctctgtctcctgggttcaagcgattgctctgcctcagcctcccaagtagctgggaccacaggcgtgcaccaccacacaggcacattttttttgtattttagtagagacagggtttcaccatgttggccaggatggccttgatctcctgacctcgtgatccgcccaccttggccctcccaattgctgggattacaggcctgagacaccatgcccagcctcctattctttatctgaaaaattaacaagatttccagttaaagtaagaattgacatctttaagagaaattctgaattatagtttattttcatacagctgtttatgtttataatctcatttttttttaattactgagaaaatagagtagctaagatctaatcttggagtgcattgttacaaaatggttgtgattgaaggaccaatttgatccattaggtaatcatttcctgcatgaatcatctgccaaaactttcacaatgaaaaggacatttggaaatgttactcttctggtttgagttgaaaacagcaaatatatcaaatgtatgccttataatgtttctgttcagatgcagcatccacccatggagacaggccctggaaatctctgctcttaaaacaaaaaaatgccatgaaacgatgtttgagacagttctccattaaagagggcacatttgtaaaatgtaaacttggatgttttgttgaagagagtagtgaaaagacaggaagatttaaaggtggaaatagggttaaatcagcaattcaaaaatacgttcatgatacagaggctgtagcagtgtataaactgtctcacagcgagggccttcgtgatgcgtcccccttctgtgctgactcatttggtaggagccctcttttccgactgtcctctcaggtttatggatgcttggtatagtgtagggattcattgcattgcacggctctggagtgcgatggccctgagtgtgagttctgcctgtgtccccggcttgctgttagaatggatctgggcaggtaacttagcttcttgaagcttcggtttcctatctgtgacctcgaaaagctgttgttgtggggattaaatgaggtattatctattcagctttggtgcaggatcaaagacagagtaagtgtctagtgaaaggttggtattactgttattacagaagtccttaatgaacaaacatttttatatgctgaatgagttaaaacatgtaactactgtgtttaacagatgtgaaattgtttaaacagttgctggcaccaagtgagcactcaggcatgttgactttgatcatcacgtgatgatgcagctggccggtgtgtgtcatctcgggacaggagagggaagtgtcagagacctggagaagtatttccctagtcagcaggtccgcttctcacttagcaggcagtgacttcccactgaagaggagggaaaggcctggggcccgtgcagggcgggggagcactgccccgtcggggcagctcccagccttctcagagctgcagtgccttcctcttgacacacacggagagggaatggagaaggaaagagctagcttagggatgccaggaaccgcagacgcaactctctttttagccccacaacagccccggggaactgtgattgttcctgtttgtggctgaagctcccagtggttaaggagccaccacagcctcacagaggcaggaaactgcagtacagggactagggcccaggctgtccatcattgcctcaggaaagttctcataaatgggggtaagtccttacagtctctccaaagtatgttagtcaggagtgtcacagatgcatcagcgataaggagaagctgctttaccgtgcgcaagttgtataattaattccttgtgaggttcatatgctttgagggctggccggggcccctacactcatctgaaacgtgatttccagggaaaagctctacaggtgtcaagcacctaccactgttttcacggtgggaaccgccactgtggaatatagtggtggggtgtttatttgattttcctactattttatgcgaatttaaatcaggctgcttatttactagtagaactcagaaacaggcaaacaaacaagaaacagagagaaacagaaaagggaacccaaagaatgttagagctggaaggaatcccaggcacggtcaaatccaaaacacagtttttacggatagggaaactgagggccaaggaggggcagggctcgccgagtttcgcctcctctgaccgcgtagaatggttgcactaaagcagattcctcgtgctgtgtatccgtcaggtaacatctgccggcacctgctgccccgggtccagtgccccgccttgattgtgcacggtgagaaggatcctctggtcccacggtttcatgccgacttcattcataagcacgtgaaaggctcacggtaagtcctgtcaccgccttcacactccccccgagagcctcggagtcaatgggcaaagctactggaaggaaaataaccaagaggagttggagttttagagtgcacagccccccttttgccaatgccagtcagtagcaccgctttatttagggtaccacggaagagagaagccctgaactgtgggtgactgataaccagaaggaaaggcatgttcagatagacagctcttactttcatgagtggcaaacatgctcataggtgctaagccctgtcacttggtaatagtttagatttatttccatcagtattaaccgaaacagtttcacacaatttgggaattttcagtttagttttttatcattataaaagcactgaccacccaatttaaaaaaatctgttaaaccaaatttctgatgtctgctgacagccagccctactcagcacagttaatggtagtgttccctgtccctaaagcccccaggccagcagggaaagcaggcacagaaacagctccactgctcccttctcgctctgttctatgatgtatttaacaacagatttctcagagaatttttaaaggaggaaaaaaagtttcttttctataataaaatacaattaccataaacctttataattactatatccataatggatagtgctatatccatttagcattttttaagttaacaggcatctctttattccacacattcctcctataccacttcaaccatgaatcaaaaatacacatgagcctgtataacaaataattcatttggtaagagcatagagtcagtgaagagcaaaggtgggagttaggcaggattatactgcgggtggacaaagaggtttaatgagggagttggtttttttttggagtcggagtctcgcactgtcacctgggctggagtgcagtggcacgatctcggctaactgcaacctccgcctcccaggttcaagcgattctcccacctcagtctcccaaataggtgggattacagggtgtgcgccaccacgcccagctaattttttgtattttcagtagagacggggtttcactgtgttagccaggatggtctcgatctcttgaccttgtgatccacccaccttggcctcccaaagtgctgggattacaggcatgaaccaccatgcccggcctgcaaaagttttttatacaatctcagtttttgtgcttttgattgtatacgtttgcagtgtacaaagtgatatctccatatagcacttaatattttaaaaggtattttatatatagtatctagttatagtttatgacatatttatgaaaaatattatccattttacagatgagaaatcatggctgagagatgttaagcaatctttcaaggttgtatagctagtaaataattaatcttagatttttctcctaatatggtgcttttccaccatagcacagctgccacttatctcttaatatgtatgatggtaacatgcctagaataagataccaggtgacctggttaattgtcttccagcttcagaaatgacaggttttgcacagtgacacacatagtaaatgtgttatgtgcccttaaagagccaggttcaattaaagtcagtctacaagaaagtttaatttaggaattaaagtttaatttaggcccatctcctagcaacacagtacatcagtataggagaaaaacacccttacaggctcacacctgtaatcccagcactttgggaggccgaggtgggcagatcacttgaggtcaggagttcaagaccagcctggccatcatggtgaaacctcgtctctactagaaatacaaaaattagccagacatggtcgtgggcacccgtaatcccagctactcaagatgctgaggcagagaatcacttgaacctgggaggcagaggttgcagcgagccaagatcacgccactgcactccagcccgggcaacaagagccgaaaccctctctgaaaaacaaacaaacaaacaaaaaaacacttaaaggcacagactatcccttcccagatttttaccaagaaatacagattatgtgtgaagcaaacaccaaactgcctttcttgcctcagaaggaggctgaacaaagggtggagttgctcagcaggtctgcttccagcttatgttaatttgtctctttctctcttctctctttgtggtagaagaaaaataagaatcgcttatttttattttaagcaaagaggccttagagatcattcaagctcagtgattttaaaatgtgtttttagtcggttgaagcccttcctctaacaagcacttgtgctgcagtctgagatacgaaacacactatgagagctgctcagacgacagcagtgatggggagcaggctttgcctttctgcctcccgtgtccacatttcctcctataagtacagcggtcgtaatagattaggacctactcatatgacttcatttcaaatcaattacctctttaaacactctacccaaaggaggtcacactctgagatgctgggggtcaggatctaagcatatcaatatgaggggtgcaattcagcccatcacagtgcttctgaggaggtgctccgatctcaggagccagaggcccggttctgggtttcagactcgactgcaaacgatgagtccctcgcctctcgcctgcggcccttctccacccctcagctcctgcctttgcctgcctgggtgtgtgcccaccccttaggccaggactcaggcggctcctcagcgaggcttcctcgcctctgcatgcgcctccagttgctcgctcacctatctgaggtcatgtggctccttataccttttttcttcctctttttttgtttttgagacagagtctcgctgttgcccaggctggagtgcagtggcgcgatcttggctcactgcaggctctgcctcctgggttcctgccattctcctgcctcagcctcccgagtagctgggactacaggcgcccaccaccacgcccggctaattttttgtatttttagtggagacggggtttcacggcgttagccaggatggtctcaatctcctgacctcgtgatgcacccgcctcggcctcccaaagtgctgggattacaggcataagccactgcacttggccttcttcttttttttttttttttttgtttttttttttaagagacagggcttgcactgtcatccaggctggagtgcagtggtgtgatcacggctcattgcagccttgaactcctggactcaagtgatcctcccacctcagcctcccaagtagctcagacataggcacgtaccaccactcctagctaattttttgtgtatgtattttgtgtagagaaagggccttgccgtgttgtccaggctggtcttgaactcctgggctcaagcaatcctcctgccttggcctcccaaagtgccgggattacaggtgtgagccactgcacccagcctctttattcatatctctaacagctgctaacgtgaatgcaattcttcccatgttgaacactccaccgcctatcccaggatgtggtctagagcatctgaacatgctcagtgcatgttgaaagagagagagggagagcaagaggtgcacagagggccatgtctctgtggatgggctggggtcaccagtgcaggaccagccgcgtattctgagcccaggcctgagggccagacccggtgggaaagtccatgtggcacagagttggcatcttaagttcgtgtcaactaaaggggagggagaggggttaagagcaccagcaggggactcagacctcggttggagtgctggtttgggtttgaatgctggtgtgggttggagtgctggtgtgggttgcagtgctggtttgggttggagtgctggtttgggtttgagttctggtgtgggtcggagtgctggtttgggtcgagtgctggttcagggtggagtgctggttcggggtggagtgctggttcggggtggagtgctggttcgggtccgagtgctggttcgggtggagtgctggttcggggtggagtgctggtgtgggttggagtgctggttcgggtccgagtgctggttcggggtggagtgctggttcggggtggagtgctggttcggggtggagtgctggtgtgggttggagtgctggttcggggtggagtgctggttcgggtccgagtgctggttcgggtggagtgctggttcagggtggagcgctggttcggggtggagtgctggtttgggtttgaatgctgattcggggtggagtgctggttcggggtggagtgctggttcagggtggagtgctggttccggttggagtgctggtgtgggttggagtgctggtgtgggtcggagtgctggtttgggtcggagtgctggtttgggtcgagtgctggttcgggttggagtgctggttcggggtggagtgctggtttgggtcggagtgctggtttgggtcgagtgctggttcaggttggagtgctggttccagctggagtgctggtttgggtcgagtgctggtttgggtcgagtgctggttcaggttggagtgctggttccggctagagtgctggtttgggtcgagtgctggtttgggtcgagtgctggttcaggttggagtgctggttccggctggagtgctggtttgggtcggagtgctggtttgggtcgagtgctggtttgggttggagtgctggttcgggttggagtgctggttccagctggagtgctggtttgggtcggagtgctggtttgggtcgagtgctggttcggggtggagtgctggttcgggtccgagtgctggttcgggtggagtgctggttcgggttggagtgctggttcggggtggagtgctgatgtgggttggagtgctggttccggttggagtgctggttcgggtcggagtgctggttcgggttggagtgctggttcggggtggagtgctggttcggggtggagtgctggttcggggtggagtgctggtgtgggttggagtgctggttctggttggagtgctgattcgggtcggagtgctggttcgggtcggagtgctggttcgggtcgagtgctggttcgggttggagtgctggttcgggtcagagtgctggttcggggtggagtgctggtgtgggttggagtgctggttccagttgagtgctgatttgggtcggagtgctggtttgggttgagtgctggtttgggtcggagtgctggtttgggtcggagtgctggttcgggttggagtgctggttccagctggagtgctggtttggggtggagtgctggtgtgggtcggagtgctggtttgggtcgagtgctggtttgggtcggagtgctggttcgggtttgagtgctggtacggggtggagtgctggttcgggttggagtgctggttcggggtggagtactggtttgggttcggggtggagtgctggttcagggtggagtgctggttcgggtcggagtgctggttcggggtggagtgctggtgtggtttggagtgctggttccagttgagtgctgatttgggtcggagtgctggtttgggttgagtgctggtttgggtcggagtgctggtttgggtcagagtgctggtttgggtcgagtgctggtttgggtcggagtgctggttcgggttggagtgctggttccggctggagtgctggtttgggtcggagtgctggtttgggtcggagtgctggtttgggcgagtgctggttcgggttggagtgctcctttggtcaccatgtgctggatgtaatatttctgtactactgttacctcttgtgtgaaatgagcatgacaatacctatcatctcaagatagtttttgaggaatgaatgaggaggtatttgtacatttggacttaaatttaagacttaacacacccagcctgggcaacatgctgaaacctcgtctctacaaaaagcaagaaattagccaggtatggtggtatgcacctgtagtccaagctactcaggaggctgaggtaggagaatcaccagagcctaggaggtggaggctgcagtgagccatgatcatgccacagcgctccagcctgggtgtaggaatgagaccccacctgaaaaataaataaataaataaaaaatactcaacagacagtagctgccacttttgaggatggaatgctggcatggatacaggtgaatagggcccccagaggacattggggcatagcttgaaattaggtcaggcaagttgccatctgttccaactttcagcaccattattatttgtgttatttttaaattttttaagagaaggtctcgctctgttgcccaggctggagtgcagtggcccgatcatagctcctggcagcctcaacctccttacttcaaaggatgctcccgcctcagcctcctgaatagctaagacaacaccattattagtgtaggtatatgggcatatttgggttctccaaaaaaaaagaaccaacaagacgtatatgtgtgtatgtatatataggtagaaaaaagagattcattttagggaattggttcatggagtatggaagctgacaagtcccaaggtctgcagagtgagttggccagctggagacccaggagagctaaaggtgtgattccagtctaagtctgaaggcctgacagccaggagaggagatggtgtggttctagtgtgaaagccaggaggcttgagacccaggaagagccaatgtttcagcctgagtccaaaggtaggaaaaagccaatatcgcagactgaaggccaaggaattccctgttctcagccttcttgttctactcaggcttttagcagattggacaagacccaccacactggggagggcctctgcctttattcagtcagtggattcaaatgctaacccatccagaaacaccctcatgaacacactcagaaataatgtttgaccaaatatctgggcaccctgtagcccagtcaagttgacacaaagtgtacagtcacagggtgaagggctgatggatgccatctctacagaggtctgggccttgtgttgggttcaccagagggtgtgctggcaggctggcagcgagggatcaggcctgggatgtctgtgcagtgggctagttactctcctctgtctggaccacagaagggaaggaagggcctctttctgcagcttccttggctgtttgggtctggccaccagtggtaagatggccctagtcctcccaggcaggccagtgggagccttaccactaggtggagtgaaatgaattggcttaggtggaaaagattcacaccagtgataatggttcattttcagctccatagaaaagtgaagccaggttctggtggggaggtagacgctgcaggcagccagggctgcagcttccgttctggactgcctccagcctggacgcagtggtttgccagctcctctgctactgccccaggtgacagttccccaccactggcatcccagccctcctcttcccaggtgctgctttcagctcctcccagctgctgctcaggtggaagggaaaaccatcagctccacacgctgcttgtgggctcgttacaggatttactgcacacagaattagccagtgcttatcaagttgagtcttttgtattaatatttcaaaaacagtgtggtctgaacctttccagacaaatcttacatgcaagattatattaaaacctctcttaagagaagaaacctccagttggaggtgttgtgttagccaacaaatgtagattaattgtgctcccctgagtcagtcattgtttaatatgctgcacagattaacaccttcaggaattctgcacattgtaaagtgcaatacaaatatactaataaaataacagcagacatttattaagcttaccacgtacccgcagaccctatgctgcatacgttgaatctactatctcattcatcctcagaatgattctatggggtagattctattactgtccgcattttccagatgaggaattgtgactcagggagatggatgtagcctgtcagtatggactctgtgctggttagacaaaactgtcctggccccgtaaagccagtgttttcctcccacgatgatgcctccagtttacatccaaatgtcacaggaagaaagctttcctgcagtccagggcccgactaggtccccacagtcacagcagatttggaaaggctttgtcctccacacaccacttaaaagcaccaacccagcagcccgagggtcctctagcagcccacttcaagccgccacactgcccagaaagtagcctccggggcagttttgcttctaatgcttgtgtctaatgcttgagacatggttgcttttgagaaatggagctgctcagtgagctgtcgcccccaccatccccaaatgcctggtcagccctaaccagaggagagcctggccagccagggcagcccccaacttcatcagcagcaaggagcttgtggtttgaccattacctttttgtttgtttgtttgtttgttgtgagatagagccttgctctattgcccgggctggagtgcagtggcgggatctcggctcactgcaacctccgcctactgggttcaagtgattctgcctcagcctcccgagtagctgggattataggcgcgcatcaccacgccggctaatttttgtgtttttggtagagatggagtttcaccacattgaccaggctggtctcgaactcctgacctcaagtgatccacctgcctcggcctcccaaaatgctgggattacaggcgtgagccaccgtgcccagtctagtacctttttcttaggtggggctttctagaagaagcagaatgaaaaaggaaaatatttagtttctgaataaaaaggggctattggcaaccaggtttggatggcgtcagaaggaatgcctgaagaagtgatatgccatgttgctgcccagtttcacactggaagagatcctgtgcaaagatccagcggcctgctttgggttccagtaaacacaaaagtacgtactggcactctgcggattacagactcactgacaacttcatggattcatagatcaagttttgttacattgatccaaggtgaaggcacgccacagcaggttacttgtggccttgttactgtctgtaactccctgagttacagatgaaagttcagctaaagatgaaaagggctccaggcggggcaggaaaggtagcatcgtgaggccagcatctcacctatggcattttgacctaaaagagctgtatcaacagaggtaaagtgacccatacatttaccttggggttagacagcttctagttccttggactatctggaaccatgtctctttctgaaggtgccacatgcagtgaggaacctgccctggcagaggaactcgtgttcatcctctgaggccccttcgtttccaactgagccatgtgcttagcagttgggggtttcctactaatttttcggagaatgttattgtttgaaaagtgctctccacagagcatgtgattagatctttttgttacttgggtgagaatctagagctcctgtcttgccttgacagctaatattcatgcccatctattgtggtcctgtttccaaagaggaacacacaacagagtttctgtgcagtgaaacctgtgtcagacctaaaggaggcaagggctgctgaggagcttgaaatgacccttaaaagatatcaaggagaagagttgtcttcatactctcttctatctgtctgtccatctgtctattcatccattcatccatccagcattcagagcaggtctcccatattttaatgaagggaacctcatttttatttccccaagatctagagattaggaagagtgcagacagtgctgaacggctaaaaagaaacgattcacagcgaggttctccttccttccttatgggaaaccaacaaatcatagccagataggctggactgtctacagagaaagacttcacatgtggcaggctggggattccctgcctcccagtccagcttagtgcagattaggggatgcaatttagcctatacgtgaccttctatgacctcgcagcatccttggcaattcgttctttcctgtttcctgaaaacaaaggccttgagtgtccctgcaagccctgttccttgtgtaggcaactgggatcctatctctggggtgggtgcaactcatccttcttttctgaatagtgttaaagttgaatttagaatgtcgtgattgttagtaatagcattactaatgttccaaggccctcggaaaggtcccaacaatatgtcttcctttcaagttgattctcttggtaccccattcccacccccaatgtggtggctgagttggaagaggcccagcatcttccaagcacagctccctgccccacagttcctccctcgcacctactgaggttctgagctgtcagccccccagtattgaaactcaaaaaattagggaacatgataacgcattctgccctaatattgtccttttaatgtctaattatcattgtagacaaagtggcttgaacttaggctttcatcctagaagctttaccacttttactgtttctatacttttgtagctaataagtcaaatgtagaacaaagagaaggctgcatttgttcaggaaactgtaaatctgtcccatttgatcacaatcctgttgaaaggaagaagccttacgaggacagtgtgtttgctacaatgctgagccgtgacagctgcagcagcggctcctggagcacagggctgctggcatgggctcaccaccctcacagccatttgtctggcggcttgtattcagatgtatttgttcagtaatccaaaaatggaagggtgatttggaaccttgagcagcaggctggggatggctgtgaattctgctttgcacttgcccactacatcaacacgccaagaaactcacctgccccatcccagtgcattctgaacatttcttatttttatcttcttaccaaccttctctcttaaaatcagcttcattaaaatggatttttctagagtaaccaccagatcacctcccccactctcagtccgttttccagtcaaaccatttgttacttgattcagttccaaatataatgtgtgtctgctactgttaagtcattgccttatagtcaacctcaagggtagtcataaactccaagagtttcacgtgtctgactatattcttaggagattgatgggttacatttttctcctcgatagtggtcatgggggaaatgtgttaatttttcactttagatgtttgtgaaatgttggggagagtgaggggtttgttcttaagtggtgggccattgacccaaagtatttttaattccttttttaggctgcatttgatgccagaaggcaaacacaacctgcatttgcgttttgcagatgaattcaacaagttagcagaagacttcctacaatgagaatgcacactccagtcttggtggttccttcgtgtggggcttgatcgtgttgctgcctgttaacatgatgcctttgaaactctccgcctttgaaactttctacccctcccttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcacttgagcccaattcaaagctgcagtgagctgtaattgcatcactgcactccaacctgggcaacagagtaagaccttgtcttaaaaaaaaataaaaacataaaaaaaaataaaaaaggaataaagcctctaacttcaatagctatgaaaattaaatccgattttctaagatgaagttgtgacaagttataccattgtcttaacaggtgaattcctgccataatttattttcaaataaattttaggtggagaatgtgtagtgttaatgttggagattttaagacatcttgaatttgtactgtaccttttatctgagaggttcaagcttcacttgtgtttttatttgtgtttatctatcatattcaaagagaagtagggagagtccgtgcccgaggtcctcaattctaagatcagaggatgtccagaacagcagcagataggggcaggtttgctttaccccatatccctctcctggttcacttttgagagatgaatactttgggccagtaaaggtgaacaaaatatgtattttcatcactctgtactaaaaggacaggaatgttattaattaaaacactaaagcagaaatcctacattgctattaaaattaaactttgattaccacaataaaaacagtagcaagttaaaccttgacactttatacttaagcatttagagaaagaataaaaattatttgaagtgagaacac

SEQ ID NO: 12780 - DNA, 2490 bp, Homo sapiens
ttttctacacatgcttttttattagtatagataccttcacagacaatactgtaatttttagaggagttccacatcattacatcaacagtgtgaatttctaacagaggcaaaactgagcaccatagtttacaagtagaaagaccatgcttgaggacaacagaagttcactaaggatgcacgattgatctgagaagtttttaagcctcgtcctcgccctcctcctcctcgaactccccttgttcgtcggccgtggcgtcctggtactgctggtactcggacaccaggtcgttcatgttgctctcggcctcggtgaactccatctcgtccatgccctcgcccgtgtaccagtgcaggaaggccttgcgccggaacatggccgtgaactgctcggagatgcgcttgaacagctcctggatggccgtgctgttgccgatgaaggtggccgacatcttcaggccgcggggcgggatgtcgcacacggccgtcttcacgttgttggggatccactccacgaagtagctgctgttcttgttctgcacgttgagcatctgctcgtccacctccttcatggacatgcggccccggaagatggcagccaccgtcaggtagcggccgtggcgcgggtcgcaggcggccatcatgttcttggagtcgaacatctgctgggtgagctcgggcaccgtgagcgcccggtactgctggctgccccggctggtcaggggcgcgaagccgggcatgaagaagtgcaggcgagggaagggcaccatgttcaccgccagcttgcgcaggtctgcgttcagctggcccgggaagcgcaggcaggtggtgaccccgctcatggtggccgacaccaggtggttgaggtccccgtaggtgggggtggtcagcttcagggtgcggaagcagatgtcatacagggcctcgttatcaatggagtaggtttcatctgtgttttccaccagctggtggacagagagggtggcgttgtagggctccaccaccgtgtctgacaccttgggtgagggcatgacgctgaaggtgttcatgatgcggtctgggtactcttcccggatcttgctgatgagcagggtgcccatcccggaccccgtgccgccccccagagagtgggtcagctggaagccctggagacagtcacagctctctgactccttcctcaccacatccaggaccgagtcgaccagctcggctccctctgtgtagtggcccttggcccagttattcccggctccactctggcctgccagagggaaagtgaacattagacactaaaacataaggaatttcaaaatctgtcattttgactatggaggagaaggtaggactggtcttagactggcagattcttctcttttgaatactcttcttttacctgaagaaatatttttctatgtcagtgacctcaaaaacactggggatcataataaagtaagaagtaagtttagctcatctgaggctattgattgaggaagaggatagggttagaaaacttaattggttctgaaatacatacatttttaagaggcattctctttatactcaactacaattaaacaggcaaggtgaaggcagtgtgaccagcagagaaggtggcctcagcatctgtctagctctggtcataacctgtgcttttggcccctggctctttgaagtcctttcaagttgcctatagcctatgaagcctggcttgaagcttttccttgctctttcttccttccagtctgaggctgctctgcaatgggagggctgcagcagccctctgcaggctggcgttgatctgtgagccatgaccacccatggactgcatggagctaggccaggactcagggctgccgtggacacagtgtcaccttggcactgaacactaagaactgtgctttgcagggctgttaggaagaaggtgtgtcatttggccagttcccagtgatcatgactacataccgaacacgaagttgtctggtctgaagatctggccgaagggtccagacctgacagagtccatggtgccaggctccagatccaccaggatggcccgaggtacatatttgttacctgcaggaaataagaactgactcaggcctgtgcttggggagggactcacagcagcattcaattccagcatctgagacaaaaggagaacaggagattttctgcttttaagaaaaaggaggtcctgagtgtgcttagccgtggcaaacaggcaggaatcttaggaaaccataaaacatgtttttccagcagttggcatttgaaatgaatatgcaagaagcatgcctttgtcacgtgcatgttcctgggacgtttcatctcccacatcatggaaagcaaggattcctgggcacacacatcccgctactcaccagcagcctcattgtagtacacgttgattctctccagctgcaagtcactgtctccatggtaactgcctgtggggtcgatcccatgctcatcgctgatgacctcccaaaactg

SEQ ID NO: 12781 - DNA, 15689 bp, Homo sapiens; identical to SEQ ID NO: 11279

SEQ ID NO: 12782 - DNA, 384 bp, Homo sapiens; identical to SEQ ID NO: 11280

SEQ ID NO: 12783 - DNA, 2266 bp, Homo sapiens
tgaattggaaccagaatagcctccgaagctgggactgtggatccaaggctgcccccaccccctgggtctcgctcacatctgcactccccagagggggcaggtggtcctggagcctagcctacctgccgagagtcagaggtggctgcaggggaaccatggcagccctccttctcacactcatcctgggcaccctgcaccagcagaagggtttacatgtacaatcacccatccctagccccttctgggagggaagcatatcttacggatggcgaccttgaggctcagggaggttaaggtgccagcctgagatcacacagccagtgagaggcagagacagggcttaaactccaaacgatggctccagagccccctctcttttccatgccctgggctgcctctttccccagtgcaccttgctttttggaaccagatgaccaatgtggaaagacacgaactgattcaatcagagtgtatggagaagggacttagagaccctggtatttttaaagctccctggtaattctcatgtgcagctagggtggggcgcctctgctctgcggaatagggaaggggtgtaagtggccctgtgtctcccctctgtccccacctgccacctgctggtccatccattcagccgttgcacggacaggttgccttctgggggctgctagcccccttgcactgggcaacgctgtgtcccctctgtccctccccccagcgcatgctcctcgctctgcccctgctgcaggtgggccatgcttggagggcgcaggagagctgagatggggtggggatggatcaggccttgagagggtgcctggtaagccccgggaagggtagggaggaggaggagggagaggagagggcagtgcaagggcagcgacccccagccttgcccccgttttgagcacggggaaagtgtacacaggtagtgaggaaatgcctgcgtttgggtgcgtgttcatttctaatccattttcactttttgtgtattctttctatctactttttaaaggtttgtttcttttctaacttcctgttttagatgtatactttagtttctttatttatttttatttatttttttgagatggagtctctgttgacaggctggagcgcagtggcgtgatcttggctcactgcaacctctgcctcccgggttcaagcgattctcctgcctcagcctcctgagtaactgggattacaggcgcgcactaccacgcccagctaatttttgcatttttagtagacatggggtttcaccttgttggccaggatggacttgatctctcgaccgcgtgatctgcccacctcggcctcccaaagtgctgggattacacgtgtgagccactgggcccggcttagtttctttatttaaagataagggtttttttttgttttgttttgtttttgagacagaatctcactctgttgcccaggcaggagtgcagtggcacagttgtagctcactgcaacctcaacctcctgggctcaagtgatcctcccacctcatctgagtatcagggactacaggcatgcactaccacacccagctaatttttgtattttttttgtagagacagggtttcgccctgttgcccaggcaacaagcaaatctgcccacctcagccttccaaaatgctgggattacaggcgtgagccaccacgcccggctagagataagtttctcaaactcctgggcttaagccatccacccaccttggccttccaaaatgttgagactacaggtgtgagcctttgcattcgccttgaattcctttttcaatagtatgtttcctactaaaaacacttatgaaaagtgtgtattttctcttaccccttctccttttttgccatctaattttagattatatttcttagtgtttgtctttaaaatgtacttatacctctatgctatctttttcttatttttgccccctcccccataagaaagataaagaaatcagagacttagaccaggtgtggtggttcccgcctgtaatcccagcactttgggaggctgaggcgggtggatcactcgaggtcaggagtttgagaccagcctggccaacatggtgaaaccctgtctctagtaaaaatacaaagttagccaggcgtagtggcaggcgcctgtaatcccagctactccagaggctgaggcaggagaattgcttgaacctgggaagtggaggttgccatgagccaggatcatgccactgcactccagcctgggcaacagagtgagaccctgactcaaaaaaaaaaa

SEQ ID NO: 12784 - DNA, 355 bp, Homo sapiens
tctaaattcatggtttatatttatatatgtccttaatcctcactcacattgccctacaggtagattcattgctcactgtcagttctcttgctgaagttttcctatttttctcttgatttgctgaaattccttctccagtagtttaatcaaaagggactaaatgaaaaaaaaatattcagttattgcaagttcaaaaaggtttctagtctttgtgtttgattgacagctttccagaatataaaattcttaggccacactttctttccttgagaacttcacagatgtcacttctgtctctagagttaaatgccactgtgggaaagtctgagtctaacttctattttgttacccttta

SEQ ID NO: 12785 - DNA, 2809 bp, Homo sapiens
tcctgttaccctctccttgcctgggctggctactctcaagcttcctggttagctggaggagctgatccatgtccttggtgaattccagtagcgtgccctccaagactctttgggcaggtccctcagagccgtaactgggagctttctctaagagcaggtgctcagagcagtggaggccttctgcgccctccctgagcaccggctcaggcaccggggtcaggctgcaggaacacatggacagggagaagtaagagtagtccactgcaacgtatgtcagcatgaagttgatggtgacgatgggggccagaacgttcacttgacccacaaaaacaaaggccatggtcaccaagctggtcaggcagatggcagccacgggtgttttgtttggccccttctgcaggaacaaaaataacatgcaggaccataaaatttcagatagaacgcttcagagatttcagaagttacaggctagaaacacaactcataatgactcagccacttctccccatgtgattattcatctataaacttgagataataatatcctactcatgggattagttcatgcatgcgaaatgcttcacacagactgacatgcagtaagctccacagatattagttgcattagcaacttttttttttttttctttttttgagaccgggtctggctctgttgcccaggctggactgcagtgatgtgatctcagctcattgcaacctccgcctcttgggcttaagccatcctcccacctcagcatcctgaatagctgggactacaggtgcacaccaccatgcatggctaatttttgtatttcttgtagagacgtggttttgctatgttgcccaggccagtcacaaactcctggcctcaagcaatctgcccaccttggcctaccagagtgttaggattacaggcatgagccactgtgcccagccataggaataactatgaacatggggcattattatagaactttgacttcccaaatatttcctccttttgtctttcattgggttttaataccagcatagaaaatcaaagaaatgcaaagttgattcttcccagggagaggcagattgcggaagacacagcagaatcactggtggctggaggaggggaattctgacactaattctgacactgagtatccgcaaatactcacacacacacattacacacacctgttattaatggaggtgggtatggtgaccttcaggtggacaggagtggaaaaaaggtgctagctgcctctcctgggagctcttcatcacagtcactgacatagttcttgggccaaaagcaacagtcacttctcagtccctgtcttctttaacccagctggctactcagtcctcttcgaaacactttcttcaccttacttctcctgattggcctccctcttcactggctgctccttcttggtttctgtggctggcttttcacgtctctgaactccacatttaaagcagccccaggctccatcctcagatctctatctgtactccctcccttggtgagctcaactaggctcacggctttgaataccggcattatactgacaacttccaaatttgaatctccagcctaaaacattcccctgaaacccaggtttacatatccaactgcctactcaacatttccagtgaacgtctaataggatctcaaacggactatgtccaaaaccaaactgcatttttggaggaagataaaggaagaaatcaaggataagttgcaacgatgtgttccctaaaccagagagaggctgaaaattggaagcggctggggaggccctctggggtaccccaacaagacaaaaatgaactctagcttgcaaaccatattagtgggaaatgggattctctgtttatgtctctttggtcctcccctggactttaggaatgtctattttaatcattccagccatgtctcaactgagctgccctttatgtatcagttaaggtttggttcatgatggttaacaggaagtgtagacgccagaggtgtaggaaatcatcaaacagcaacccccaaggggcggttgaaactcaagggcagagttagagctgcaaggaccagctcgcctcctgaccaaaacacgctttcttctatgctaaacctggaggatcctgaattcattttcattaaaggatggggcactgcattttcatgctgctcagggtccaagatggtactaggactggttagctaacccagtcctaaaagtgctaaggggctgggtggctgggacatttaagatgcttcatctacttagccctaacctaagccagccagaggacagggctgaaagaaatgacctctgcattattttctgtgtcaccccaaagaaattgaccagaggctctgatcagaaaagcttaaccaattgatgggccaacagtgaggttagcagcaaaacatgtttcaaaaaacaaaccaaaaaaagaggattactcaccccttgtcccagacaggcaagtgcagggatcactttctcctgggcaatgcactgcaggatgcggggagctccataaagtcctcccatgcaggaagccagggacgagatgtataagcccaaaaggaacaggaagcccatgagggatacctgtgtgagaagcggtttcattcgccagtgccagaacctgctcctgtgcctttctacccccccagcacccacccacctgcaccccatgcaatcatccactgagtcgtctagatctgatccctgggatacagtttccacatccccagcctcgcccccattcattccatggtttcagctgaatccaccaccacatttcatatggattg

SEQ ID NO: 12786 - DNA, 2809 bp, Homo sapiens
tcctgttaccctctccttgcctgggctggctactctcaagcttcctggttagctggaggagctgatccatgtccttggtgaattccagtagcgtgccctccaagactctttgggcaggtccctcagagccgtaactgggagctttctctaagagcaggtgctcagagcagtggaggccttctgcgccctccctgagcaccggctcaggcaccggggtcaggctgcaggaacacatggacagggagaagtaagagtagtccactgcaacgtatgtcagcatgaagttgatggtgacgatgggggccagaacgttcacttgacccacaaaaacaaaggccatggtcaccaagctggtcaggcagatggcagccacgggtgttttgtttggccccttctgcaggaacaaaaataacatgcaggaccataaaatttcagatagaacgcttcagagatttcagaagttacaggctagaaacacaactcataatgactcagccacttctccccatgtgattattcatctataaacttgagataataatatcctactcatgggattagttcatgcatgcgaaatgcttcacacagactgacatgcagtaagctccacagatattagttgcattagcaacttttttttttttttctttttttgagaccgggtctggctctgttgcccaggctggactgcagtgatgtgatctcagctcattgcaacctccgcctcttgggcttaagccatcctcccacctcagcatcctgaatagctgggactacaggtgcacaccaccatgcatggctaatttttgtatttcttgtagagacgtggttttgctatgttgcccaggccagtcacaaactcctggcctcaagcaatctgcccaccttggcctaccagagtgttaggattacaggcatgagccactgtgcccagccataggaataactatgaacatggggctttattatagaactttgacttcccaaatatttcctccttttgtctttcattgggttttaataccagcatagaaaatcaaagaaatgcaaagttgattcttcccagggagaggcagattgcggaagacacagcagaatcactggtggctggaggaggggaattctgacactaattctgacactgagtatccgcaaatactcacacacacacattacacacacctgttattaatggaggtgggtatggtgaccttcaggtggacaggagtggaaaaaaggtgctagctgcctctcctgggagctcttcatcacagtcactgacatagttcttgggccaaaagcaacagtcacttctcagtccctgtcttctttaacccagctggctactcagtcctcttcgaaacactttcttcaccttacttctcctgattggcctccctcttcactggctgctccttcttggtttctgtggctggcttttcacgtctctgaactccacatttaaagcagccccaggctccatcctcagatctctatctgtactccctcccttggtgagctcaactaggctcacggctttgaataccggcattatactgacaacttccaaatttgaatctccagcctaaaacattcccctgaaacccaggtttacatatccaactgcctactcaacatttccagtgaacgtctaataggatctcaaacggactatgtccaaaaccaaactgcatttttggaggaagataaaggaagaaatcaaggataagttgcaacgatgtgttccctaaaccagagagaggctgaaaattggaagcggctggggaggccctctggggtaccccaacaagacaaaaatgaactctagcttgcaaaccatattagtgggaaatgggattctctgtttatgtctctttggtcctcccctggactttaggaatgtctattttaatcattccagccatgtctcaactgagctgccctttatgtatcagttaaggtttggttcatgatggttaacaggaagtgtagacgccagaggtgtaggaaatcatcaaacagcaacccccaaggggcggttgaaactcaagggcagagttagagctgcaaggaccagctcgcctcctgaccaaaacacgctttcttctatgctaaacctggaggatcctgaattcattttcattaaaggatggggcactgcattttcatgctgctcagggtccaagatggtactaggactggttagctaacccagtcctaaaagtgctaaggggctgggtggctgggacatttaagatgcttcatctacttagccctaacctaagccagccagaggacagggctgaaagaaatgacctctgcattattttctgtgtcaccccaaagaaattgaccagaggctctgatcagaaaagcttaaccaattgatgggccaacagtgaggttagcagcaaaacatgtttcaaaaaacaaaccaaaaaaagaggattactcaccccttgtcccagacaggcaagtgcagggatcactttctcctgggcaatgcactgcaggatgcggggagctccataaagtcctcccatgcaggaagccagggacgagatgtataagcccaaaaggaacaggaagcccatgagggatacctgtgtgagaagcggtttcattcgccagtgccagaacctgctcctgtgcctttctacccccccagcacccacccacctgcaccccatgcaatcatccactgagtcgtctagatctgatccctgggatacagtttccacatccccagcctcgcccccattcattccatggtttcagctgaatccaccaccacatttcatatggattg

SEQ ID NO: 12787 - DNA, 2705 bp, Homo sapiens
actctttgggcaggtccctcagagccgtaactgggagctttctctaagagcaggtgctcagagcagtggaggccttctgcgccctccctgagcaccggctcaggcaccggggtcaggctgcaggaacacatggacagggagaagtaagagtagtccactgcaacgtatgtcagcatgaagttgatggtgacgatgggggccagaacgttcacttgacccacaaaaacaaaggccatggtcaccaagctggtcaggcagatggcagccacgggtgttttgtttggccccttctgcaggaacaaaaataacatgcaggaccataaaatttcagatagaacgcttcagagatttcagaagttacaggctagaaacacaactcataatgactcagccacttctccccatgtgattattcatctataaacttgagataataatatcctactcatgggattagttcatgcatgcgaaatgcttcacacagactgacatgcagtaagctccacagatattagttgcattagcaacttttttttttttttctttttttgagaccgggtctggctctgttgcccaggctggactgcagtgatgtgatctcagctcattgcaacctccgcctcttgggcttaagccatcctcccacctcagcatcctgaatagctgggactacaggtgcacaccaccatgcatggctaatttttgtatttcttgtagagacgtggttttgctatgttgcccaggccagtcacaaactcctggcctcaagcaatctgcccaccttggcctaccagagtgttaggattacaggcatgagccactgtgcccagccataggaataactatgaacatggggctttattatagaactttgacttcccaaatatttcctccttttgtctttcattgggttttaataccagcatagaaaatcaaagaaatgcaaagttgattcttcccagggagaggcagattgcggaagacacagcagaatcactggtggctggaggaggggaattctgacactaattctgacactgagtatccgcaaatactcacacacacacattacacacacctgttattaatggaggtgggtatggtgaccttcaggtggacaggagtggaaaaaaggtgctagctgcctctcctgggagctcttcatcacagtcactgacatagttcttgggccaaaagcaacagtcacttctcagtccctgtcttctttaacccagctggctactcagtcctcttcgaaacactttcttcaccttacttctcctgattggcctccctcttcactggctgctccttcttggtttctgtggctggcttttcacgtctctgaactccacatttaaagcagccccaggctccatcctcagatctctatctgtactccctcccttggtgagctcaactaggctcacggctttgaataccggcattatactgacaacttccaaatttgaatctccagcctaaaacattcccctgaaacccaggtttacatatccaactgcctactcaacatttccagtgaacgtctaataggatctcaaacggactatgtccaaaaccaaactgcatttttggaggaagataaaggaagaaatcaaggataagttgcaacgatgtgttccctaaaccagagagaggctgaaaattggaagcggctggggaggccctctggggtaccccaacaagacaaaaatgaactctagcttgcaaaccatattagtgggaaatgggattctctgtttatgtctctttggtcctcccctggactttaggaatgtctattttaatcattccagccatgtctcaactgagctgccctttatgtatcagttaaggtttggttcatgatggttaacaggaagtgtagacgccagaggtgtaggaaatcatcaaacagcaacccccaaggggcggttgaaactcaagggcagagttagagctgcaaggaccagctcgcctcctgaccaaaacacgctttcttctatgctaaacctggaggatcctgaattcattttcattaaaggatggggcactgcattttcatgctgctcagggtccaagatggtactaggactggttagctaacccagtcctaaaagtgctaaggggctgggtggctgggacatttaagatgcttcatctacttagccctaacctaagccagccagaggacagggctgaaagaaatgacctctgcattattttctgtgtcaccccaaagaaattgaccagaggctctgatcagaaaagcttaaccaattgatgggccaacagtgaggttagcagcaaaacatgtttcaaaaaacaaaccaaaaaaagaggattactcaccccttgtcccagacaggcaagtgcagggatcactttctcctgggcaatgcactgcaggatgcggggagctccataaagtcctcccatgcaggaagccagggacgagatgtataagcccaaaaggaacaggaagcccatgagggatacctgtgtgagaagcggtttcattcgccagtgccagaacctgctcctgtgcctttctacccccccagcacccacccacctgcaccccatgcaatcatccactgagtcgtctagatctgatccctgggatacagtttccacatccccagcctcgcccccattcattccatggtttcagctgaatccaccaccacatttcatatggattg

SEQ ID NO: 12788 - DNA, 3203 bp, Homo sapiens
atttctgaattgtggcagagcttagatcctgcacccaggggtctttttttcaaacagcatcttgctcagttctgtgaacagaaggctttgttactgaaggaggtggaagaggagtttagggtgaaaaggaggaagggatggacagacccaggtgaggagaggcctggggattggggaagctgtcatctcagtgttaataatcaacttgcttctaacacactggcttatcaggggaggtcatccagtccggtcggtggagttgagagcccttgggccagggtgtttggcggcacaggggcatccgctggatggcctggaggagtgggggaggggaacgtcttcactgggtggtgatcagctgggacagttcaggtagggcaggtgagggacccccgaggccctggagccttgtcctgggatgggtttgaagaactcatcactcatcacttgttttcttttggcttttgttgtttttgttttgttctgtttgttttgttttgtatttctttgttattttattgggaaggtaagcggaatgtgctcatagaccatcagacgcttgtcgaaggcaggtcctagtcatgtaattgcacaggacaaggaggtcagcgtgtgtgatggcagcatgctgtgccggcacatcgtggagtcctagaaactctctagtccctgcggctgttcccctcctctgctctctccctggagaggactgccagctcttaagaaacattcctggtgcggtgtctgcagtgccctttgtgggtgacttcaggcttcccgctttcgtggtgctcttcctgggattcgtttttttattaccctccctccctacttgtaggcctcagctatggcttgacgtaatcgcttttagacccaggttggcttcccttcattaagctatgatcctccaccccattttttttttttttaatttggagtgggagggaggggggtgggcgagagaaagctcgaaaggtattattggtttttcaaaaaattagaggtgacgattctaccagggagttgactgataggagtgtgtgcagggcaggaaaggttcggaggcacccgactaccaccactcggaaagccgctagtccagatcgactagggagaggcttagatactttagtgtatttaaagagcatttcagttaactttttcagctatttttaaagtttgtgaatggagtgttattttggacattcttaaatatgaattctccaaaggcatttagccttgacttaatattaaatcctaaggattttatgtaaggtttttttgcaacctatttaattttttttaaatgcctaacttctgaggtgcataagcccgtggtttgtgtactggaactaaagcggaactcactgattcatattggatccccaggtataccttctgctggtagcatatggctggaaaaggccgtttgcctcacacattgtaacctgccttggctagaaaatgcttttaatgtctcaactctctcttttctgtgtcatgttttggtaggaaatctttaagattggcggacggaacaggtattttagtgagacacttctgagtacttgctttttcctttgacttctaaccaactaaaagagaaggaggtcttcatgttgatattttgcttggttttattttactgattttaaaaggtatatagaaaaatgtaggcctttaaaaagaaacagcatgtagttttttattttaatatgttccatagagtggataggcagacaggtactattgtaatgtattctgtatttaataatttaatatactctagaaagtagacctcatgcattcttttagcatgattttcttttaaactgcttttcattttaagggcacccgtggcggaagctggttttgcaaggactgtgtaagctgtatgcgttctagctgtatgcgttctgtagtcttttcttaggtgggtaacattttcaataacgcgcgcacagcacacaggggtgccctgagccgaaggagcaaaaaaagccaccgctcgtttctataatccagctttgcttttcacaggcgtgggatccaggatggtgtcctctgtgaggacttgaactctggggctttaattccactgtttaattttcaggtaccacagcagcaaagcacagagtgtgacctttttcatgtctgagctgattctgtttgctccacgtgcctgcttcttgctactgttcatttagtaatgggatcacctcaccatgccatgctctgggctctccctctctgtccatttctgttttgctttcctggctaaacccatctaccattcttaacactggtagctcctgtcccattccaagactcactctctcagaccttcccatctccctggctttccatgctcctctccctccacctcctggcttcaactgggtgagggccgtattcctgccactctgctccgcctcagccttgagaactccacgtgggctgggtgggaaggtgctgacgattttcacactgtgtttaccactccatcacctctcaacctttgcttcgacaggtcttcactcacgatttattcctccaggtctttgattggagagagtaactttttaattctgttgttttgcagtttggctctgtaggagtgagtggcgattcaaagatgccggcgtcccgcagtgtgcggttcgtgcccttaaccacccgcttctttgtttcccgcccctctgctttcgcaggagctcttgtgcttgagttcagtgttagtggtagcgtggctcactccacttggaggtggcggccgtctgaccgtgtgttactgctttgccgacggggcctcccggccctgatgcgtgtacactctgcgggctgcaccgggtggctctggttgggggcgaagctgtgttgactgggagagcgttggaaattgagacatggagagatgacgggagtgcgtttctctgggtttgatctccatcctgttttctcccagacacaccacacctaccttgggggaatgccgttgcctgttccacccctttgttcacttcgcgttaactgctgtggtaactttttcaggatctgtgtgaagaatggtaatgacgtagttgaaaggaaaatgtactgttgtgtgtttcatttgtgtgatttcgtaccaaaaaaatgtgtttgaactatattgtatgtaatttggaagtcgtgttaataaaaccctgcagtttccactctgg

SEQ ID NO: 12789 - DNA, 3230 bp, Homo sapiens
cctttttatatgatgcgtttttattaaacaggacccaccgggctcttttagtttcctcccaccttggtaggttgattgccgatgtgcagggttagtgtcgatcgtttctttaaattttcacaggcatatgatagatttgtcccacataaatgtggccctgatcgtggagtgagtcctaacaagagagcctgaccttaggctgtacacacactgtggaatttcttcaagggagctgccggccggcgcagaacccccaggagcacaggtctctccgggccgctgtcctgcgtaactgttctccagagcgccagccagccacgggcctgattccagaggagccgaactgacaggacacagcaggctggagttggtgttagattgcttcacattctcttgtcaccaccaagaactccaagtttttcgttttgttttgttttcaaagtgcttacaatgcatgtagacattgttctttgtggtctgactctatgatcgatcacagtgacttagattcaggaaagaacattaacgtcacaagttctaagtagttttcacagcaaagaatatttgataatggttgcacttatcttcagtgcaggttagaagagtcttctcaaccaagcttaactcgagttgtcttctcagccctcaaaaggctcttgtacaaaatgtagattaaaatttgggtgattgttgattgacctttgcataccctggaaagccagggtgtgagtggggtggttgggagtggtgccagttgaacagcagattctgcttcttgtcactgtttcaaaagcgtcaactctgtgttcctagtttcgatgaactccccattcatttttaacacacttcccagataaggcaatgtgctggacaggcacacggcatggccctcggctagagcagggtctgtgatggcctcacctggcagccctctggcctagttcccaccacacatgaggtggtggaatggcctgaaggtggaacagacctgtttttttcctttttaaatgcagtaaggtggcctgtttatcactggctctgtgatacatgacattctttgggaatttggtggccactgcttcagtcacctctgtttttctgaaggctgttccagcagggctgccctgttcatcagcggatgttcactctggcctgccgttccccgtggcatgcggggtgagggtggctttcttccagccccaaatgagacgagtctgtgtcatcattgaaactgcttttcgtaattgcgggtaggttcctgtaggtgagacatattctccataaagctactgtagtagaattcattctgggcaaacactgaaaaaagtgccttacagtatttctgctcatgaaagagtttcactattttggatatattctaaagtggacctgagctatttgagcaaataatgatagggcatactcagacattttagctaccttttatacctacgatttcatgtcacatttactaatagaattaagggaaatagaagcccgttctttcttactgcccctggagggagcatggcgctagggctctcagcctcctagaaggaagggactaaggagacgggcacagacttgcgtcatctcgtttccacagttgacgttttatattactttctcaaattaagttaccaaaacaaactgaagagctgaagcaggtcttccagaccctgcgatcctttctgtagcagtgattctaaagtggcgtttgctgtgtgcttgagagtaacactgcacgctgcaggggctgttgcagcagtcagtcccaggaagccacagcgcttgtaggatctgctaggaccctgcagctgtgctgccgccacctctgctccagagtgtcccagccaaccctcggaagatgggattgccagtcagccctgcctcaccatgcctgcaggaggctgtccagggagcaggtctgtgtgcccatcagcaggttcccatggctgtcactgcccactcatttccacagttagatacggatgtgttgatgtatttcgtctagtttatttggctcagtccacagctgcgttggagtggtgactttggtagcccttgagctctaattaagagagatccaaaccactcagtacccactgggcagtgggaaggcctaccgacttactttatcattgagggcttactgatacaatgaaatgagtttcatgactttttttttttttaaacactttttgaaatagagtgtgctgtgtttaaaaccaaaaatatgcatgttgtctctgaaaagtaggcattgaaacagacttttttgtagtcagtgttaataaaacggatcctgtttgggccttcattgttaaggtggacttcatggccactggaaggtctgttttggtgttacctgagtgtgacacaggccctggggtgtgcgtgtttctctaactgtctacacgtgcacataggcagactttctcatagaatgttcttgaaaggtgattggcaaagtcatgcaggcccgccttaaagcgctgattagaacagtccaacacagtccgacctcactcaatacccacaaccatcgaaaatggattcttagtaccagacaatcccagtaatgaaggtttagtttccttgaaggaaactacagaaaaggaaagaagcagaatgagaaaggaatggtacttaggtgtttggtatgctgctcacgtgaagtcagcccacaccagccaaaccctcgtggaagatctgctgcaaccattatctttgttcttgagttcatcatgcatttaaaatgagatgcaagagcatttagcataccatgtaaatatggaccttttaaaattaaaatactattggaagtgctttcaactcagccacatcttagctattagttctttgtgttgtcttatcaaagtttaatggatacagttccacagttgttgatgtgtttgtgtgtatattcgatttttataaagatggtagtaagtcaatacatttatcctgatctgtgtattatttgttcacaaattcaagaagcttaaaggtcgtaaatatcagtatctcataaggtaaaccaatagctgattatgtggagccaagttacttcttttctttttgcattatcttgttttggttttgtgctgtaatagaagttcacttagctactttagataaccttgcattaccactggtctggccacgtttgttaaatccttatactgatattcttctaaagagtaaatctcatcatttttccagacaaa

SEQ ID NO: 12790 - DNA, 729 bp, Homo sapiens
aactcctgacctcaggtgatccgcccacctcggcctcccaaagtgttgggattacaggcatgagacaccgcgcccggcgtttttttttttttttttttctttcaggaatttgggctgggcatggtggctcatgcctgtgatcccagagctttgggaagccgaggcaggaggattgcttgagcccaccagttcaagaccagcctgggcaacatagtgagacactgtatctacaaaaaattaaaaaattagccaggcggctggacaaggtggctcacgcctgtaattctagcactttgggaggccaaggtgggcagatcacctgagatcgagagttcaagaccagcctgaccaacatggagaaaccctgtctctactaaaaatacaaaattagctgggcgtggtggcgcatgcctgtaatcccagctacttgggaggctgaggcaggagaatcacttgaacccgggatgcagaagttgcggtgagccaagatcatgccgttgcactccagcctgggtaacaagagtgaaactccatctcaaagaaaaaaaaaaaaattagccaggcatggtggcacagctatagtcccagctactcagtaggctgaagtgggaggactgcttaagcctggggtgccaaggatgcagtgagctgtgatcacgccactgtactccagcctgggtgacagagtgagactctgtcaaaaaaaaaaaaagaaaaaaagagaaaaag

SEQ ID NO: 12791 - DNA, 775 bp, Homo sapiens
ggactattttcgtaagaatatttttctgcaaactgatgtagttagtagatgtcattatactaatgaaaggacattagctattttatcataaagtatgcaccagcactttgcagattcagtgaaactctaaaaatgtctttatctagcaacataatagaaaatactatgatagacatccaaccataaacaaattagaacaggcaacacaaatgcctttttcagtttagtgaaatagcgtagcagttgcttagttgatggtgacgtggtaacatacatatgccgatctgtgagcatttcatttggcctctactagctttcatacctcaaattttgagttcaggtctcagagtttttctttcatttacacagcaaaaccaccaggaaagagactttaaaagagactatcaggcatgacaagatactagtgaatcaaaaacgtacttaaaaaataaagcaaacgaggccaggcacggtggctcaggcctgtaatcccagcactttgggaggctgaggcgggtggatcacgagatcaggagatcgagaccatcctggctaacatggtgaaaccctgtctctactaaaaatccaaaaaattagccaggcgtggtggtgggcacctgtagtcacagctccggtggtgtgaacccgggaggcggagcttacagtgagcgctacagatagcgctactgcactcctgcctgggcgacatagcgagactccgtctcaaaaaaataataataaaataaaataaataaaaaataaaataaaataaaaa

SEQ ID NO: 12792 - DNA, 921 bp, Homo sapiens
ggtgctaattcttaataatttctatttaatttttttgtaaattttaaccagaacctaagctctgactttgtgattcagttatgtttgtatatacatgtcttcatttttgagtgagtaagaatattagagttgttctatggatttgatgcgatatatgcattgtgattttaaggagagcatgtttctcatttagatattgactagaaatagagaaaacctaaccaacaacttcttaatttactttgtttgtttaatgagcagtttgggtttggtattaatttctgccttcataaatttcccttctcttgaataatgaggatctttcaacccactgcccttccatgtgaaaatggttttttaaacaaccttggttatagttttaaacttcgctggaagaattaggtcatccaaaatatgtgtggggtgtgaagttttgttttctgcacaaagacttgtcatgagtctaaacatttctctctcaagtaatttacaatttaattaccttgtgttatgttccctcaggaaggggaggagaagggaaaggaagaaaaggcaaaaaaaaaaagttttaaaaatgtgtgctgcattcaggatttagatttcaccttataaagtttttattacagcgtcctcctcccctcattgtgccatgaaatagtgaatcactctgcttggtctctgaggacagatgctgttctcatgttttatcctgacacctccgagatgagctttccatatgaaggaagggaggacatttgatgtgtccagtgttgttctggggcctccccttctctggaagtcactgacacgtgtagttttggcattgaagcccagcgggagacgacatttggccaattcccctgctgattaatgtgcctgagggtccatgccaccctttgcccccttccagtgcattagttt

SEQ ID NO: 12793 - DNA, 299 bp, Homo sapiens
cattgcttggctcccacagagaattttcccagtaacttcctttactaggcaagcgtttattaaaatgtgttcctgtccacagaaaattcaggattcgggacgggggtacaccacacttaccaacactttgagtcgtgccattaagcatcgtgtatgcaagtaacagattaggaagcaaaaaggccacattgtcatggaatctaaatcctgagtaaaatgtaagttgtttagggtttcccattctgcaaagaccacatttctgtaattttatgttaacttactatatgttttgaagaacc

SEQ ID NO: 12794 - DNA, 242 bp, Homo sapiens; identical to SEQ ID NO: 11266

SEQ ID NO: 12795 - DNA, 38771 bp, Homo sapiens
  misc_feature (29356)..(30880): n equals a,t,g, or c
gaaggaaatttgtgattagaagccgcgctgttcttatttaagagcgttagcgcaacttccggtattgttgcaagatggccgcgcccagtgatggattcaagcctcgtgaacgaagcggtggggagcaggcacaggactgggatgctctgccacccaagcggccccgactaggggcaggaaacaagatcggaggccgtaggcttattgtggtgctggaaggggccagtctggagacagtcaaggtagtttgggacaggaagtggagaagtagtaaatcgataggttgggactccgtggaatgagggtaaggggcccagagtggatgtagaaagcagagaggggtgaaagatgcttttgaaggaaggtggcttggttggctttgcgttgatttgacatcctgggatggtagtactcatttttctttctttttttttttttttttgagacggagtctcgctctgtcgcccaggctggagtgcagttgcgcgacctcggctcactgcaacttctgcctcccgccttcaaacagttctcctgactcagcctctggagtagctgggactacaggcaggtgccaccacgcccggctaatttttttgtatttttagttcagatggggtttcaccatgttggccacgctggtctcgaactcctgacctcaagtgatccgcccgcctcggcctcccaaagtgttgggattagaggcgtgagccactgtgcccggccggtagtactcattttcttttgctctttttgaatgatattctagccctcacctccttgcttccaattggtttaccaggattctgtggtatagtagtctaagcagaggaaagtttcgttccttgcgtcattccacatcccaagacaagttactgggcagatgagaaacgtagttatgtagcctagtctgcccacactttttgtaagggcttcgtgtttcaattcattagtatccatagtcacctctctctaatatccacctatgatacactgtccagacctggttattatttaaaacttttacatctgcatttttatctatcattcatctctttccccacatgtaatagaaccagcagttctctatcttaaagccttgggcagtgttcttcctcctcctttctcttacccgttagaactaattgaataggcccagaagaaatcgcattggtttagaagtcaggccaggattttaatcttcgttctaaatacacttttttttttttttttttttgagatggagtctcagtctctaccaggctggagtgcagtggcacgatcttggctcactgcagcctccgcctcccgggttcaatcgattctcctgcctcagcctccagagtagctgggattacaggcctgcgcctgtaatctattaaaagaatagaaaacatgattatatcctactaatgggttgaaactgtattattcattcaagaaggtttttttcttctataactaagggtgtctcatggacttagttcttggtcatttgttctttgtgctctctgtgacattacttcaactattcaatttcaaaatctacatcccttttttcgcagactttttggagccatatatctcaagaatgttgctagacatatacattccagtgatacataaaaacttaaccttccaaaacttgtatttgtatataacagtttgtttttagactttttactgaccaccctaatgctccttgggactccaaattgcaacttggaattatttcttttagctgctacagatgtagtccacttctttaacatcaaacttctgatgtcttttccagtgtacagagagttgttaggatagtgtctgtcagtcattcccatcctgccctgcttactccagaattatttttggctttgtgcttgatacattaggattctgtggtttacaaagcagcttcatatataatcactgccctttagtgtctcagctcccaattttcctcaaaatttcctttcttcgtttccactttttcttttttgtttcttttttgagatagggtcttgctctgttgcctgggcaacagagtgcagtggtgtgatggttcactgcagcctctacttccctggctcaagcagtcctcccacctcatcctcctgagtaactgggactgccagcaaatggcactgcgcctggctaatttttttttttttttttgtgagacagggtcccaccgtgttgcccaggccggtctcaaattcctgggctcaagtgatccttccacctcggcctcctaaagtgttgggatcacaggcataagccaccacacctggctactttgtcttgattccatctgtacctttgctcatgccagtctttcttttttcttttttttgagacagggtcttgctggagtgcagtggtacagtcttggctcactgcaatctctgtctcctgggctcaagccatcctcccaccttagcctcccaagtagctaggactacaggcatgtgccaccatgcccagctaatttttgtatttttagtagagatggggtttcgccatgttgcccaggctggtcttgaactcctgaccttaagtgatttgcctgccttggcctcccagagtgctgggattacagccgtgagccactgcatctgcccccatgcccgtcttaaaactgggaataacccctcttccttttacttctgagagttttctttgattaaactgcctcctgcatcattagttttcacatttcttttttttgagatggagtctcgctctgttgcccgggctggagtgcagtggcgctgcaagctccgcctcctgggttcatgccattctcctgcctctgcctcccaagtagctgggactacaggcgcctgccaccatgcccggctaattttttatatttttagtagagatggggtttcaccgtgttagccacgatggtctcaatctcctgaccttgtgatctgcccgcctcggcctcccaaagtgctgggattacaggcgtgagccaccacgcccggccttcacatttcttgttcagatttgcagctcttcacttagtgcatgtttggtgtacgcaaactgagggtggtgactcgatattttgcacagtacctacttactgctcctgtaataaacacagcattcagccttgctaactactaactcctgcctagttccaggatgtctcattggccttgcctaacagccacaggttttttaattaaatccagtgtattagtagataatgtgaagtcacaggttgtgcccttcctcctgtttccctctcagaccattcactggggagtgcaaataaggctgcacagtaatcccccgaagggcttgctgggctccacccccagtgttcctggtttagtaggtctagggtgggcctgagaatttgcctaacaagtttccaggtgcagctgctgctggtagtttggggaccacacttgaagaaccacggggctaggtaacagaagcttatgctgttctctcgtcatgttccctgttcttcaggtagggaagacatatgagctactcaactgtgacaagcacaagtctatattgttgaagaatggacgggaccctggggaagcgcggccagatatcacccaccaggtaactccagggacagtgctcacaaccctttgagcctctgtatggaagggttggcagctgagtgctgcctctcttcagccttaaccatgtctcggtttctgctttgctcagagtttgctgatgctgatggatagtcccctgaaccgagctggcttgctacaggtttatatccatacacagaagaatgttctgattgaagtgaatccccagacccgaattcccagaacctttgaccgcttttgtggcctcatgggtaagaagccttagaacaaagttagaatgaacttgtcagtagggaagaagggaggaagaggaaaagggagaactaaatgtggatttttaagcgagaaaatgggagaacaacatgattaataccaggacaaggactgttattatttttctatgtttgtggaaactccactcctgttcttgcagtagcttcctggctgagtgaaagagggagtctgaacccatcactgtacagctagccatatgcttggcaactgtttgttcctaacatttcaggagtccagtctagatataaagcacacagggaactcatcttatccatggggttttccttgttcgatgactggacagaaggactgtggtctccatctagctctgaactcttttttcccccttctagttcaacttttacacaagctcagtgttcgagcagctgatggcccccagaagcttttgaaggtgaggtattgaaacctgttagttgaaggctggttctgggaatgtttctggggctgacttttctctcttttttactttaggtaattaagaatccagtatcagatcactttccagttggatgtatgaaagttggcacttctttttccatcccggttgtcagtgatgtgcgtgagctggtgcccagcagtgatcctattgtttttgtggtaggggcctttgcccatggcaaggtaaggtctgggctcaaccctgaaattcttggtagagctgaacttagtatagaattcccagagcagtaggcattttaacaatgcttacaatgagctagaagacacatgacagttccacaccctgccccagggcacatcctttgagggctgctgccataattggaagtcacagttaggaccttcttcatcctttgtagggatttgatattcaacagcacagctgaaatactagctcagccatagttttcctgccctaaagaagggctgaaacagctactgagtgacagagttggctgacaaaactgttcttttcttaggtcagtgtggagtatacagagaagatggtgtccatcagtaactaccccctttctgctgccctcacctgtgcaaaacttaccacagcctttgaggaagtatggggggtcatttgacagtagtagaacctgttctgaaaccagaaactgttgatgtcacatcctttgaccctggtctgagctgactgctggaagatgatctttctgcactgagactgtggagtttggggaagccaaggctgtacatttgctatttgtttatcctatgaatactgttcttgcaaacctggttgttttggggttcctaaagtatccagtggtgtaaaactgtttgttccccgggacttcagggacagataggaggttacagagtttgcagtttggttccatgctttgaaggcaggctttagctcccagattcccatgtgctaaaggagagaaccctgatgatggagaagaactgtgaaagagagcagtcaggaatgctagtggtgaaaaactgaacaaacagaagtgattttatctaatacagttccaaggtagaaaaagtggagcaggcagggccttgcacccctctccacccccccatggggggggtggtggtagcggcacatacacaatcatagtaaattggcagaagaaaaacacaatagattcctggctagatggggagagataaggcaatgtgcatgggggaatcagaggggagatgtgagcccctctgctcctcccacaagagtttcccctttgggccgggcacggtggctcacgcctgtaatcccagcactttgggaggcggaggcgggtggatcacttgcggtcaggagttcgagaccagcctggccaacgtggtgaaatcccgtttctactgaaaatacaaaaattagctgggcatggtggcgtgcctgtattcccagctacttgggaggctgaggcaggaaaatcacttgaacccaggaggtggaggttgcggtgagctgagatcccgccactgcattccagcgtgggtgacaaagcaagacgccttctccaaaaaaaagtttcccctttggccccaaatgaagacttggctggcagcagaggcacagctggaagcatcgatcttccacctccctggcttttccattctctgctctggggcaaaggagtgctgtgaaaagggagacgagtagtttctgcaccagtcccgcacaggccacctgcaagacaagaggagtttggaaggctggttagttactcctgtaattcctggtctatagcccttccagatgtttcctagcatgcctcaataagtcacagtagtcattgcccatactgtgttccttagtagccaggctaatccttggaattcaccccagatttctaatactattgtttttttccagtctgttgctctattctgtaacctggtggtagttttagtttagctgtattaacttaccagggaaatggattattccatcttctttaacttctctttccttggcaccattgctttgtgaatataaggcaatatgaatagtaggctcaggaagaagatgtggccaaggaaatagatggatttatacacctgtggagagagaggccactaaggtagacaggcctggagtgtcctttgcaacctttgaggttgcagtgagtccctcccagtctcacaagcaggccttcacttgccttaagccatttgtcccacgtgaagaggcagaaggcagtcatggagtaacccatgaagagccagtggatggtctgttgcaccaaatagtagaagggctggaggacagtaatggcggccagcttgctcagggtggggctctcttgaatgagcctggcagcctggggagggaggaggagctcatcagcatcttgtcccttatattccccttcacccccaccctggaggcctacctgtctttccacaataacaatgaggaattccatctggaagcagaccaggtatcctgagtgcaggccgtgccagagggccaggaatagcaacgagagaccctgagagagttctttatttccaaggaacttgagtcgtttgaagatgtagctggagaaaagggtgggtggggcgaccctcaaactgactggtccttgcatcccgccacctgcctctgggtcctcaccctgaggattggattggagtgctggtgggttcccacgtgtagcccccagagggtacaggaggcagtgctgactgattacttttagagatggaaagcagacccaaggcggagctggagaccgtgtgcgcacgagccacttggttcagcagcagtgactgaggctgatgctgagatcagtggtgaaccagacactctactcaagctgcccacactctagtggtggggacaaacaagtaaagctgttgataaacagggcagtggaggacataagtccattggcagagctggagtaacacccaggtcttaacgcacttttatatcttgcctttttttcaaatatgacagtaatggtttttttgggaggggggtataggtgggggtcaaagtcagtgtgagcgacagggggttctgcccagatgggaaagacgcataggggtgacatggtacacccctgccctccaatctgggaagacagtggaaggaaggaaccagggtccaggctccccaccagcagctcaccgggccacccaggcgttggtgttgatgttgaatgaggcaatggtgccagtgaagcgggggtttgtttcaaagagccacaccttcatgttggcacaggcatcccactttgccttgcccttttcttcaaagccattgaagcccaggcccgtcaaaatgcatactccttcctgagagggaatagctcagttagggctcttgccactccccatactggcccccatggcttgtctaaataggaccttgtttcaacttttctacttactgtgaccagccaacaggtgacatatttgtacagcacaaacttgccccagatcagcatgtacatgcagcggaaccagaaggggtggttcttgagggaagaaagcacagtgcattagggatatcacatgactaggcagtttctctcagcactcttccttttcacacttgtggctggctacttcatacctgcctgagtcctgctgccagatgccctcaatagtctggcctgattgccttcacaataggcagagaggaataagcagagggcctggagaatattcattcgcctttcccttggagagcctcaagggcagcactgtatttaacttctctactgtttgccttcgttggcaaagtgtttggaatgagcatttggaatgttaagtacagaggggcccatattggattttaatttaaggagagaaacctgcccagaattactgaactgttttcaagcctttcagctgggcaggagcaaaagccagcacttccccccttcccttggtttctgaattccctagaagtgcccaaatgtatcagtcaagagaagaaaataggatggagaatcagaagctgctgtgctctgaggggtcacgtggatgtgataaggcaagctaggagcggctcctagagaaggcaacgggtgctaaatgtgcacctggcacagccctgtgcccgcgaaggttgttcagtgctggctgatgaacatgtcccagcacggctggcattgacaactcacagatctagagcaaaaccaacatgcacttgtagatgatatttcctacttctctgctatctgtagggatccttgcctgtccattttctagctctggtgcagtcatgctgctgctgctttagtagacactcacgtcatagtcttcagtgaggagatagtcttctgtgatgtgggggctgagcagtgtgtagcccactaggtagaaaaggcccagactcaggcgcttgagagcaggaatgatgctggaaaggaacgagtgaagttcctggtcacagagagcagagactattcccttcaccctctgaccttcagttatggagaggagtgtttaggggtgtggttgtctacctggaatgggatgagaagctctgctgcccaaagtgtttcctgtttcagggaaagatttctatggctggctatgaggaatggggactgcaaacctcttaagagttgtaggaaagtcagggcagcagacagtggaccagtcttgtgtttacccctcagggatgctactgatctcaaggtcttgccaggtctcacaatctccattgggactgaaaacccagtggaggtaagataataaaaataaccactttgaatctgctccttcatttcttggttgaattgatgctgaaacacaggatggacaagttctcagtgaaggaattcttctggcaattaaactttttttttttttttttttttaccattttaatttttattttctagagtcagggccttgctctgccactccggctagagtacagaggcatagtcattgctcgctgtggccttgaactcctgggctcaagcgatccccttgccttggccacctgagtagctgggactataggcatgtaccaccttgcctggataatttttttttgtagagatggggtctcactatgttgcccaggctggtcttgaactcctggcctccagtgatcctcctgccttggcctcccagagcgttggcattacaggcatgagccactgtgccctcctgcatttcctactgataaatatttttgagacaggattttgctatgttgcccagaatggagtgcagtggtgtgatcaaagctcactgcagccttgacccacctcccctggactcaagcaattctcccacttcagcctcctatgtagcttggactacagatgcatgccactatgtctgataatttttgtatttttttgtagagacagagtctctctatgttgccaggctggtctagaactcacgggctcaagtgatcctcccacctcggcctcccaaagtgctgggattatagaggtgaaaccactgtgcccagcctctatctacctacctacctatcaacctgcctacctacctatcaatcataaatatatttcatatatacatgaaaataggctttaaaggcagaaatgtgactggttcaggcaaaatcctgtggcataaatgtggatttttatgtttgtactagtgttagaatggataactggaagaaccctaaactaaaaagggcccactcctggcacagagtgcctgttacaacagtccagggcctgcatgactcaggtctctatgccagggtcatgctggagaatgcagctttcagaagagtcacttcagagtgagtgaaatacctacacaaacatctggaccaagaggggcaattacctgtttggtatctttcctggtatgtcaatcagctctccctgcaccagcttcatgtagtgattcattgagaactggggccctaccaagaaggccccatagaagtaggagaaaccagcaacttccagcagggaaggaacaccacgtatggcatatttctgttgctcagaggacaaggaattctatgccaagaagagaatgcatggttcaggatagccttgaatctccccacaagagccactttgagtgttccccacctgtgtgccccactgactggggttcttcaaatagccttctctttgggggatgacaaatagttgcttcttgtggaaatgcgtatgtgtgtgcatagctggctgttgctgctttagcaaatgccttgctggcattgatctctggactttgtgcaagagctggatcctgggcaaattagatttgttgatccttgctcagtgctatctgaaagggagattgcacaggctggggaatgagggagaggctccgctctggaatttgggttcagtcttttgttaacaacttttttcttccctttcattaagtcttgaacctctctgccgatgaatgggtacttacctgatctttccctccgtcaaagtagtcaacagccaaacctgagcagagagagaacggatgggtagggtggtgggagaggacactgaggatgtggcctgtagactgagtgcagccagaagtgtatggcggggggcggagggggggtgccgaggaagtttttagtgagatgggggagggacctacatgtaaggaaggcaggcagtgaccatcactcaccaatcagcttcaaagtcagaacacaatgtggcattgtccacttgatatcgtagttgccggtggcagtgtaatagtatccagccagaaggtaggcctaggagaggcagaagtatttattctagcatcactactatttcttctccttgctctgaaattcaatgttctctttcctttttcctttctcctcatcccatcattaaaagccttaataaattcctacaaatggaggtgctgaaaacctgtaatgggaagagcgttgctcaaggcttcttggcaaaatgagggctaaactgagatgagaatttagatgctgggaccacaggtgcatgccaccccacccggctaatttttaattttttttgtttcaccatgttgcccaggctggagggctaatttttgtattttttttgtagagatggggtttcaccatgttgcccgggttagtctcaaactcctgggctcaagcaatctgactgccttggcctcccaaggtgctgggattacaggtgtgagccactttgcctggcctaggcttaggttctttaactcattctaagttgcttttctgtcttgccttgaagtgactctgctcctggatagtgggttaaaccaaagagcctaatggcacagtatgcaaagggttagctggtggcccttccttgaggcaggcaaagagttaccattacaatctgtggatggaacacttgggcctgtgataagccacctacctgaagtcatactgctaagtgctgggagaggggttagaaattaggtctgctaatttctataccacagtcccctgcctacccctgtcccctgaaccgctgtcagctgtagcctgagctgctaagggaaagacgtttaccatctggaagcaaaaggtagtgaggacggcagtgatggtgcggcccattagtcgaaggatgaggaactgaagcacaatacacagcagggagtggtagagctggtttcctggatgcaagaagagagaatttagcctggtttttacactcccaccgtcctgagacttccaatcacaacgtaatatataaagaaaaaatgttggcatcaggatcttttttttcagaataacctcatgttttggaggagaggatggaaattatttattaaaataaaaaagattattagggtgttattttatttcttttctttttttgtttgtttttttagagatgcgacttgctctgttgtccagacttgagtgcagtagctcaatcatagctcactgcagccttgaattccgggctaccacacccagcttgttactgtatttttgaatgtctgaagtgaagaatgaatctaagtggggactgcttggctcggtcattcagttacatccacagcacagagaaactgaggattctttgttgatgaggtatggcaagggtaaccaccctcaaaatgtttttatctgacagaagaatgtacataaaagaaaaaaaggaaaagttaagctgtgttcctcttcatacaaccctctttgcaagtgggagcattataacttccctacctattagattctctcaaggaaattttgttcaagtctgttccttccaggttcccactaattgcggtgtcactgctaatttagtttactcaccaaagttaaaataagcaattgagaggcctgtaaaggtatggaagaggtggatgaggtaggtctccttgtagaaaaggtaatgccgataaaacaaagcaaaggggtaacctagatgggggaaaagataagaagagtgttatttgtgcctggtgccatcccagtttggtttggaagtttatctggcatgaaacgcagcccagagggagagagaaaaaaaaaacaacatacattatatggatggcaacagagaaggcaataacggtatccccaagaaccaaaagttttttgtaaatacaaattttgaactaaagatattaatatttgattgaggcaatataaagctgggtcctaagactaggtttcatttatagcttatgaactattgccagacattttctcttacttgaattttaaaaaatgatacaaggaagctaggcatggtggctcccatgtataatcccagcactctgggaggctgaggcaaggggattgcttgagccgaggagttcgacaccagcctgagcaacatagcgaaaccccgtctctattaaaaaacaagatacaaagatttgagcgtacccatctatgctccagaaacactcatttacactttgtgatctatcttgctagcactgtattatcagattatgaggaaaaatataaattaatatcaggctaaatactggaattgctgactgcatatatagcagttacaagttatgtggagatactcctcacagtctgtaatctgggcatcaaccaagttataaaatccatttaagtatactaaaaaaatgtcttctaaagccatgattcagagtatagtccaaaggccatgagtgaaccacagaggatcttctgatgggtcatgaactgattatacatggccaagggttgcttattgaattaaaaacggtcaataaaatttggtattcctaaactaaaattagcacattccatggctttactgcagactcaccttcagtgttctatctagaggtctggcggccatgcctggcaacatccccactgcactagtgcatatgtggaggatggggatctctcaactgctttttggaaagacattctgcctattctttcattgattattctcttgagttggtcatggtttatactttctgcaattcttgcttttatttttatttattttgagacagggtctcttgctctgtcacccaggctggagtgcagtggcacgatcatcgctcactgcagccttgacctcctgggctcaagtgatcctccaacttcagcctcttgagtagctgggaccacaggtgcttgccaccatgcctggctattttgtaatttttgtggacatgagttctcactatgttgcccaggctggccttgacctcctgggctcaaggaatcttcctgccttggcctcccaaagtgttgggattacaggcgtgagtcactgtgcctgatgaattgctgcgattcttgcttttaaattatgtaactgcagtttttatcatgggcaatacagtttactgtgagtttgcttaactctaaaacgcttagaatagtatcatacagaaataaattgctcaattatttgttaaataagtaaatgcacacaatcatgttatatgttggtttctgtccttctagtcatttttcccccatacattaaaaaaaaaaaaaaaaaaaaggctgggcgcggtggctcatgcctgtaatcccagcactatgggaggctgagacgggcggatcatgaggacaggagatcgagactatcctggctaacacggtgaaaccccgtctctactaaaaatacaaaaaaaaaaattagccgggtgtggtggcgggcgcctatagtcccagctactagggaggctgaggcaggagaatggcatgaacacgggaggcggagcttgcagtgagctgagatggcaccactgcactccagcctgggcgacagagcgagattccgtctcaaaaaaccaaaataaaacaaaacaaaaaactgtactggctggtgcagtggctcacgcctgtaaaccaaggcactttgggaggctgaggtgggtggatcacttgagatccggagtttgagaccatactggccaacatggtgaaaccccatctctaccaaaaatataaaaaattagctgggtgtggtggcgggtgcctgtaatcccagctactcgggaggctgaggcaggagaatcacttgaacctgggaggcagagtttgcagtgagctgagatcgtgccattgcactccagcttgggcaacagagcgagactctgtctcaaaacaaacaaacaaacaaatgccatttgatcttcctggtgccaggatcaactggtgtttttttttttttttgagatggagtttagctgtttttacccaggctggagagtgcaatggcacgatcttggcagctcactgcaacctccggcccctaggttcaagcgattctcctgcttcagcctcccaagtagctgggattacaggtgcccgccaccatgcccagtgaatttttgtatttttagtagagacggtatttcaccatgttggccaggctggtctcgaactcctgacctcaggtgatccacctgccttggcctcccaaagtgctaggattacaggcgtgagccaccacgcccggccaactggtgtttttttttttaattgctgttcccataataggctaggctcttaaatttatagcttcatgcaagtatagttgacccttgatcaacacaattttgaacagcaagggtccccttagacttccctctgcctctgccactgctgagatggcaaccctttctctttctcctcctccttgcctgctcaacctgaagatcatgaggaggaagacctttatgctgatccacttccactgaatgaagagtaaacatattttttcttgcttatgattctcttaataacattttcttttctatagtttactttatggtaagaaatacatatataacacaaatgacatacaaaatatatgttaatcaacttgtttatgctattggtaagtcttctattagtagttaagtttttggagagtcaaaagttatatgtggccgggtgtggtggctcatgcctgtaatctcagcactttgggaggctgaagcaggtggatcacgaggtcaggaaatcgagaccatcctggctaacatggtgaaattccgtctctactaaaatacaaaaaattagctgggcatggtggcacacacctgtagtcccagctactcaggaggctgaggcaggggaatcgcttgaacctgggaggcagaggttgcagtgagcagagattgcagtgagcagagagagccactgcactccagcctggtgacagagtgagactctgtctcaaaaaaaaaaaaaaaaaaaaaaaaagttacacctgtcggccgggtgcggcagctcacacctgtaatcccctactttgggaggcttaggcgggtgggtcgcctgagatcaggagtttgagacgagcctggccaacatggtgaaaccccatctctactaaaaatacaaaaattagttaggcgtggtgcaggcacctgtaatcccacctacttgggaagctgaggcaggagaattgcttgaacccaggaggcggaggtggcagtgagctgagatcacgccattgcactccagcttgggcaacgagcaagattctgtctcaaaaaaaaaagaaaaaaaagttttatgaggatttttgactgtacaaggggtgggatcccataggacctgcgctgttcaaggctcaactgtaattaattctacagatatcttatggattactggctcatgtattcattcaccaagtgtttagtaaatgcctgctatatgccaggtattctgtttatgaagcacgtaattgggtaggaggtggcatgtgatggttcgttttctagctggctgagatgatgggatataggatcactagctctagggaggtggagacatctatgaccctttcaggtagatcaatgagcaaggaaataggatcaagtctcatatatttcacatgggcagaaatttggcagagacagaacaccaggttagcagcaaatattgctaagaactagagccaggaactagaaagtatatagactaaatgtcaatgccttcaatcttttgctttatttttacttttgttttagtaacggggtataaataaaaaaatataaaacagtagataattatctagagcactcataaataagttctaggtagctaagtttctctctttaagcatgaaaacccttaaccatttggaatgctcgaaattaaaaaacaccacacatattactctgcctctttaagttgaatctaatttaacattttctaggtgtctggatcgtatctattccagagtaaagtcatgatggctttatgacgttctgaggtatgtgaaattgtctgcctgactctaacaaggcctacactgtcctgagttctgagttcttgtgtccacttcttatagcctgtctgtccctttccttgctactctgggatcaacagtcacctcttgaacttttggggtgcttggcaatagttcctctccctactcctaatttacggcaggccttagaaaccataaccttattttaaaggtgtaaaaaaaaaaagatttaagacaaaagcaaggggcttgggtgctttccttatggacttaggcctggtaacatctgttctggccacttagaggccttgtgtgctatttcttgttttcaggtgcgttttgcaggaggggacgttgttgagttccaaacaggtgaggtattgcacactagcaaacacatgagaagaaggcggaggaattgggagaaaaataaaaagaatgcagcaggccaggttagcaggaacgttaagacggtgacggagaacagcaaagcctggaagcaagccgccgtggagaaggaagaactgtgctgaggtgagttgctgtgacaacccaggctgattttgagtatgtaaacaccaaaccttgttcttggctgccgctcagctcagcgggctttggagcctggctgcccagccaccacttcagggatgtgctgtttttagggagggtgtgaccctacaagatgtttctgagccttaatgcttttttgtgggagccaatgcttaatatggtggctagagttacctgaagaatctataaaaaatgaccgaagccccttctgctcaccctcccactcatcagagttggcttccgtgggtctgagtgggaaggacttccacttttaacagcatgagacacggttctgacagccccactaacatccgaatgcaggccgcagtgctcagtcctgaggataaaattctcagcttggagattggggttgatgccttacctttattagcaccagatgggtttgtaacaacccagaggtttgtaagaacttgttggccgggcgccgtggctcacgcctgtaatcccagcactttgggaggccgaggcaggcggatcacctgaggtcaggagtttgagactagcctcaacatggagaaaccctgtctctactaaaaaaaatacaaaattagctgggcgtggtagtgcatgcctgtaatcccagctactcgggaggctgaggcagaattgcttgaacctgggaggtggaggttgtggtgagccgagatcacgccattgcactccagcctggcaacaagagcgaaactccatctcaaaaaaaaaaaaagaacttgtttggcagcactgtaactgttccttctttttgattgtttgtttaaagcagggacttcagaaatttattagcaggcgaaggatgatgacctttagtacactccaaacctgaggatcttctactagaatgggacctttataatccctaatgctagggacattcaaaatgcgtgttttttttttttttttttgagacagagtctctgtcgcccaggctggagtgcagtggtgcaatctcggctcactgcaagctccgcctcccgggttcacgccattctcctgcctcagcctctccgagtagctgggactacaggcgcccgccatcacgcccagctaattttttgtatttttagtagagacagggtttcaccgtggtctcgatctcctgacctcgtgatccgcccgcctcggcctcccaaagtgctgggattacaagcgtgagtcaccgtgcccggccaatgctgtggtctttcaagcagctgctgggatacatttaatttgtacaagccctcttcaggggttgtagtcaagcacagggagtggatagaactgtattattcagtctctggacttcactcagttccaagtgctgtttgtgtcagggaccagatctatcacaacgtgcattgttagcgggaacgttttcttatttcctgtacaatagttgtgagattacttattaatcctaaagttgtgaggtttcatctgaagaaacagaaatggactgtttccattaagtctggtaaatttggctgggagtggtggctcacacctgtaatcccagtgctttgggaggctgagacgggagaatcactggaacccaggagtttgagaccagcctgggcaacatagcaagactctgtctctacaaaaaataaaaaaaatagttgggtggggtgggtggtgcgtgcctgtagtcccagctacttgagaggctgaggcaggaggatcacctgagtctggggagacagaagctacaatgagctacgatgatgccactgcactccagcctgggcaacaaagttgttttttttgagaccctgtctcaaaaataaataaataaataaataaaaataaaaaaaatataagcggggcacggtggctcatgcctgtaatcccagcacttcgggaggctgaggcgggcggatcacgaggtcaggagatcgagaccatcctggttaacatggtgaaaccctgtctctactaaaaatacaaaaaattagccgggtgtggtggcgggcacctgtagccccagctactcgggaggctgaggcaggagaatggtgtgaacctgggaggcagagcttgcagtgagccgagattgtgccactgcactccagcctgggcgacacagtgagactccgcctcaaaaagaaaattaaaataaaataaataaataaataaataaataaataaataaataaattgagcaccccaaacaacttttgttaatgtgggaactatatatcaatgtctactgtgttagaaaataagactaaaaactgggtgtggtggctcactcctgtaatcccaatgctttgggaggccgaggtgggtggatcacttgaggtcaggagtttgagaccatcctggccaacatggtgaaaccctactaaaaatacaaaaaccagccagacatggtggcaggcgcctgtgatcccagctacttgggaggctgaggcaggagaatcgcttgaacccaggaggtgggggttgtagtgagctgagatcacgccactgtgctccagactaggcaacagagcgagactccaaatcaaaaaaaaaaaaaaaaggaagaaaataaaactaaaaaaaaagtaaaagatatgattaattcagtaaaaatattaacagtaaaactactacacattatattaatataaataacatactttaaatgtaaaccactatatttcccaaaacaatcaaagaaataaagccatctaatgagaagaatgccactgttttacattttcataaatttatggcctctgtctgacttaatagaagatgactggattctcaaatctgcttctgcatttaatctgttgtaatatgttagtttggttaaaatatacaaagaaaatctggctttacacagacagagaaagtatctgcattttcagataattttggatattctttagcgctacatcaaaacttgacaagtagtagtttcttaacagttaggaacttttgttataataaaacccattggcttctcttgcactttgaatggatattttaccatgcatgactttgtaacatcacacatagatcactgcaaaatactggttccctgttgttaggcagatcttctaaatactgacatatttcattagaatacatatcaaaaaatcatattccttaaatttcaccattgatttcagcagaaaagtctgtatatattgaaaagtggtcaagctcatgggagtggatacaagttttccaaaattctaatttttacttgaaagtgtaaattttatcactggctacaaatattgtcatttgtttaccttgaagtgacaggctcacttcatacagtttcaagagactgtctgccagatgcctaagtctaaaaccatagtttgtctatcattctttcaagtaaaaatggtggtcggtgaaaaaagaagctgctaaatcaatatgcaacttgaataatcgcccaaatgcttttccttgtgacaaccaccgtactctaccagtgtgcagcagaggcggtttatgcatatttcccatttcttcaaacaagtttaaaaagatgtactcaggatcaggcatggtggcccacacctcccagcactctgggaggccaagacgggtagatcactttaggtcaggagttccagaccagcctggccaacatggcgaaaccccgtctctactaaaaatacaaaaattagctgggtgtggtggtgcataccagttaaaaaaaaaagatttattcaaggactgacatttgatacaattaacaatatttagcctgggcgacagagtgaaaccccatctctaaaaacaaaacaaaacaaaacaaaaacaaaaattagccaggtgtggtggtgcacacctgtagcctcagctactcaggaggctgaggtagcatcacctgagcccaggaagttgaggcggcagtgagctgtgatgcccccaccgcactctagcctgggtaagaccctgcctcaaaaaaaaaaaacaaaaaaaatttaccacttcatcaacgattcttaagtgaaactggctctgttttgattgtgagtgcatggcagtaaagaatgcagtgaccactggtacagtttggtgtcaccgtcctgatttgtgctaaggcgccagcagttttaccaccattttgcaacatcagtgcaagtgtcaacatagggaaaagacaaatacatcttagtagtatcatgaaaataatttttaccccaaagagattccttaaagaagtctcaggaacttttaggagtagtctatggactgcatgctgatatggaatgatttgttttaatctttcatcttctaatacccaaatccactagtctttcctttctccctggtttccttgactgccctgctgtgttttcaatctttttgaaacttctctttcactggtttcattggttttgaatacagttatctcttggtgtccatgaaggattggttctagtactcgcagcagacaccacagatgctcaagtcccttatataatatggtgtagtattgcatgtaacctatgcacatcttcacatacactttaaatcatctctggattactcataatacctaatataatgtaaatgcaatgcaaatagctgctatatagcatattgttttttatttatatttttattattgtattattatttagcttagaatccatgaatgtggaacccacaaatatggagggctgactatacacagtttcctggatttttttctactgagatataatttaccataaaattcacccttcaaagtgtaaaatgtaatgttttttagtatattcaaaaggttgtcgccgggcatggtggcttatgcctgtaatcccagcactttgggagccggaggagggcagatcacgaggtcaggagatcaagaccatcctggccaacatggtgaaaccctgtctctactaacaaaaaattagctgggcgtggtggtgcctgcctgtagtcccagctactcaggaggctgagggaggagaattgcttgaacccaggaggcagagattgcagtgagctgagattgcgccactgcactccagcctggcaacagagcgagactccatctcaaaaagaaaaaaaaaaaaggttgtgcagccatccccactatctatctaatttcagaatatcttcatcacctcaagtagaaaccccatacatgttggcagtcatttcccattctctcttaactcccagagcctggcaaccattcatctactttatgtctctatagattggcctattctaggtgtttcatataaatggcgtcaggcaatgtgtagacctttgtgtctggcttatttcacttagcatgttttcaaggttcatccatgttgtagcatgtatcagtacttcattcctgtttatggctgaataatatcccgttgtatggatactctgcattcttttttttaacatttaaaaattttttatagacaaggtctcactatgttgctcaggctggtcttgaattcctgagctcaaatgatctgtccacctcagcttcccaaagtgctaggattgcaggcatgagccactacgcccagcctggatactctgcatataatctacccattcatcagctgacaaacaactgggttgtttccactttaggaacattatgaagaatgctgctacaaacattcatgcattttgtagagacagggtctcactatgttgcctaggccggtcttgaactcctggcctcaaatgatcctcctgctttggcctcccagagtgctgcaattacaggtatgagcccatgtacaagtttttgtgtgaacatatgtttttatgttttcaattctcttgggtatatacctaggaatggatctcctggatctttttcttttttttccctttgggacagagtctctctgtgttgtccaggctgaagtgcagtggcatgatcttggctcacggcaacctccgcttcccaggttcaagtgattctcctgtctcagcctcccgagtagctgggattacaggtgtgcaccaccatgcccagctaatttttgtattttcagtagagatggggtttctccatgttggccaggctagtctcgaactcctgacctcaagtgatcgacctgccttggcgtcccaaagtgctgggattacaggcgtgagccaccgggctgttgcccacgctggagtgcagtggcatgctcacagctcactgcagcctcaactttctaggttcaagtgatcctcccacctgagcctccctagcagctgggactacaggtgtgcacaggaccggctaatttcttgtagagttggagtttcaccatgttgctcaggctggtctcgaactcctgagctcaagcaatctgcccgccttggcctcccaaagtgttgggattacaggcatcagccactgtgcttggccaatgttcactcttactttctgtgcttacttctggcatgggttggctgactacaatttgaatagacccatctttccgtttctttcaccgaaggcattttttctggctcctagatgttgctgacccccaggatccagtcttggccctccactattcttgctacactgcttctttggaaactcatctactctcaagtaacttaatataatctttatgccaaagacagatccacatctttagttctaacttctttttcagttccacatttcctacttccttgctggacagttttaatttgatatttcattaccatctcaaactctgtataactaaggcataaatttctccctaaatcagccttctctgggctttttttttttttttaaattaacagtgttaccattctccaggtcacacaacattcaaaagtgtgttttcctgccagggcatggtggctccacgtctgtaatcccagcactttgggaggccaaggcaggcggatcaccaggtcaagagttcaagaccagcctgaccaacatggtgaaaccccatctctactaaaaatacaaaaattagccgggcgtggtggtgcatgcctgtaatcccagctactcaggaggctgaggcaggagaatcgcttgaacccaggaggcggaggttgcagtgagctgagatcgtctcactgtactccagcctgggcaacagagccagactccgtctcaaaaaaaaaaaaaaagtgttttccttcttcatattggttctctgttatctagtcatgaaatcctgttgattcctcctttccagtctctctcaccatcactgtcaccatgaccatcaccactccctttttcctctgctgatttgcagttaaaacccttatggatctcacccttaaatccttgcaatggcctcctacctgatctctgcctgcaccacgtcttcccagcagtcctataccggggtaatcttccttcagctcctgctcagaaaccatcaatagctcccagctgactactcaacagagtcagcaatcctgtctgttctaccttcaaaataaatccaaaatctgaccacttctctccgcctctactgcttcccctggtctgagttgccactatctctggattattattattaatatatcattattatattcaatgtattatcattatatacttgcctcctgactgatctcaccctgcctttgcctcccttcagtctagccttaatgaagcatctagagggttctattcaacttaagtcagcaggtcactcctctgctcaaagccctctcaaggcctctattctcactcagatcaaaaggctgattgccagcacccgcaggttctgtccctctgcccgggccccactgtcctctgactcatctctcaatctggcctctacccttctgctccagccccaaagctttcccttcctggaatgttaagcaggtccagccttggtgccttcacatggtaagttccttgcctggaaggctctttgcacagataagctcaaatccttcctacacctcaggtcctttgtaaaatgtcaccataagtatcagtgaggacttccctatcttatctagaagtgtatacaacactacccctccccaccctgtaaccctcccccatcacacacttcttgttcttctttcctgctttttctatttttcttctcagtacttattaccttttgacataccatatatcttacttttcagtctttcaaagcagggattatcatctactttagtccctaccgtaccccagtgcatagtacagttcctggtacacaaaatttctcaaaaagtattagctgaatggccgaacaatgagtgaacaagtgctctgtactctaggcagtcaatacaatatttattaagcactcactatgtggttagcattgcattaggcattgggggaatatggtagaattttaagaggtgctttctattcttaaggagcaaaatcaaacaatgatgttctatgctaagggctaactgtatggaatagccaatgttgtagaggttaaagagaaatcaatctcgaccacagtggtcgggagaagtagttcttgaacagagaagagatgacggcattccaagggaggataatgtagtaaagacacagcggtaggaaggagcatggggcattcactccaagagactgggctaatttcaagggaggaaaaatattgtaacaaaatggatgggaaagtgaaaaaccaggcagagtctgaaattgataaatgggaaaaaaaaaatcaattgactaggtgtaggagaaggaaaaggacaaattaaagatgtttatgccactgatataatggtcttcaggtcttcaaacctttttgctggcatagctcctagaagaattttgaaaaactgtatatcctcctttcacattttaaagttgccatctaaaccttatgtttttatttctttatttttttattttcttgagacagtacttcactctgttgcccaggctggagtgcagcggcacaatcacagctcactgcagtttcaacttcctgggttcaagtgatcctcctgcctgagcctcccaagtagctaggactataggtatgtgccgccatgcccccaaaacaacagcaaattatgtgtgtgtgtgtgtgtgtgtgtgtgtgtgtgtgtgtgtgtgtgtgtgtttcaagacacagtctcactctgttgcccaggctggagtgcagtggtgcaatcttggcttactgcaacctctgcctcccaggttcaagcgattctcctgcctcagcctcccaggtagatgggattacaactgtgtgtcaccatgcatggctgattttcttttctttttttttttttgagatggagtttcgctcttgttgcccaggctggagtgcaatggcgtgatctcggctcaccgtaacctctgcctcctgggttcaagtgattctcctgcctcagcctcccaagtagctgggattacaggcaggcgccaccacacggggctaattttgtatttttagtagagacaggatttcaccatgttggtcaggctggtctcgaactcctgacctcaggtgatcctcctgccttagcttcccaaagtgctgggattacaggcgagagccactgcacctggccgcatggctgatttttgtatttttagtagagtagggtttcaccatgttggccaggctggtcttaaactcctgacctcaagtgatctgcctgcctcagcctcctaaagtgctgggcataagccaccatccctagtcagtgtgtgtgttttgaggcagggtcttgctctgtcgcaaaggctggagtgcaatggcacagtcatggctcactgcagccttgatctcctgggctcaagtgatcttccgacctcagacccctgagtagctgagaccacaggaatgtactaccacattcagataattttaaaattttttgtagagatggcatcttgctatattgcccaggctggtcttgaactgctgggctcaagcaatcctcctgcctcagcctcacaaagtattggcattacaggtgtgagctactatgtttggccgtgtgtgtgctttctaatgcctattgaaggtgtgttttaagtgcttatggcagatgtctgccatgcaatctaaatggcaaaccaatcagctggatcagtcttacttacaacacacctggcctgtccctcaacttttctattctttcaccaaaatggaagttccttatgttagagaacttacagagaaaaggaagacaaaggaaaataggaaggagagttaagctctgcctgacactgtctacttaagtgatgggtaactgattaggttcagtgcttagaacttcatataatgagatacaaaatctcattactgacccactctgccagctagaagagcacttgtagatcatggacatttaggtggggatatagccacctttgatcctttctgttcactagattaagccttgttgctagtacaggcaggagccaacataccttccacactccagcaatcctgtacaccttgggctgagtcatatgctgaacagttattcatgaatacagattcttacttagaactgaagaattacctgctccaaacccttcattaggtagataagagactaaggtccaaaggggataactggcatgcccaaggttaacagagcagagctcaaattagaatccacatcacctgatttccattctactattcttgccacatgccttggcacttggcagtgacctgggagtgaatcactaataaccagctgtgtgctcttttaaagctacagctctattattctttgatgtccagataacaatctatgctccagcacctgtttatagacataagcacacccatttttatgtttgcttatcctcctattgaaaaatattttaaaagttcattttaatgctaaatttaggtgtactttctttgttaatctaattcttgagcactctgcacccttcagcagttcatttctgaaagttacctccacctaaatagctcaagcattgtgacagctgtgatacaggactcatggaaactgggacaagtgatcaaaaatgtctgagggaggaacaatagaggggacattttaaaggtaagctattggatagttgttacctgtgagaaagaaagaaaaagggttaggttaagaaatgttagttttttactctctcaacccagccaaacaacctaaacttgaactgtcccaaaggcctaccaaaattctttaatttcttcacttaagctgagtgctcttaataagcaagacttctgaggtgtagtgctagtgattaatgttatacacacccgttggctgactggtgaaacctgctgcaataactaaaaattattctataaaaatgtatagacagagagaatgttaaagctaaaagaggccgttgactcatttctttgttttagtagaacaggtgcaacagattgaggcactttaagacatctaaatggctttactagcaaagataaaaatcacacttgcctgtactcagggaattttatcacattctaattctttgtaaatcagtgaatcccctggtgcaacttctagccagattatctgggctttggaatcagaattatctagtttaaaatttagctctgcagcttgggcaaattacttacattctttttttttttttttttttttgagacagagtctcgctctgttcctcaggctggagtgcagtagtgcagtcttggctcactgaaacctctgcctctcaggttcaagcaattctcctgcctcagcctcccaagtagctgggactacaggcgtgtgccaccatgcctggctaatttttgtatttttagtagagatggggtttcaccatgttggtcaggctggtcttgaactcctgacctctggtgatccgcccgcctcagactcccaaagtgctgggattataggcgtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaaaaaaaaaaaaaaaagcgaaaatatttgcaaaagtagcatacatgtacttccttcaggccacttaaaatacttatgcatgtctaaatattttatataagcatacctacacctaacttcttaaaaattgagtattctttttttgagacggctgtcgcccaggctagagtgcagtggcgcgatctcggctcactgcaagctccgcctcccgggttcacgccattctcctgcctcagcctcctgggtagctgggactacaggtgcccgccaccacgcctggctaattttttgtatttttagtggagacggggtttcaccgtgttagccaggatagtctcgatctcctgacctcgtgatctgcccgcctcagcctcccaaagtgctgggattataggtgtgagccactgcgcccggccgaaaattgagtattcttttaatggattttaagatataaaatctcaggctcagaaatttgagccacctaggggtgagaaattttggcctttgcccgcttcgaactgacttaactaaattaaatctatagaaagtaaaaaataaaggtctgtgaatgtacccagtactctcaggaagaagcatatttgccatgaagctaaaaaagcttcagtttcactccccttccaaggctctggggggtggggtgggggcgggagctagcaacgtgctcacatggtcatatatttttgtaaaacttatagaagatatttttgtattctttttcttaaagaagatatccaagattgtataagcttcagatcccagaaatcctagatttaaaaaaaataatcaaccaccaccccaacaaaattaggcacatgcctgaaaattctgctgctactgccagaattctgcgggtaggggcttcatccaaggtgttcctaataataggcagagtccccagattagttccggtgaggcttttgggaggggttatttggcgcggtgttggtgttggtaggatcctggctgtgaggctgaggcaggcctgaggagggctggggctgacaggtaggcagagttggctgggatgtgaggtgcaaggggtggtacttcggaaacaaactttgaagaggagaaggggcagcaagactgtgagtctggactttgtgatacactgtcacccctagtttagtgtgcctggttagggagaatcaagcagcatggaacccctcttcctttttcactaacatttttctgtatagtggttgaaacccagtgttaagagactgcatgacattggaaaagaaggggaggagaaaaagagtccatatgaggcaagaacagaacgcagccagaattagggcaggcagggaaaggaagggagtgagatgtgggagtcgggggggagttgaggtaacctgcattttatatgctagagctacgtattttagatgcaggggcaactgtttcggtccaggagtggaaaggactgtagaagcaatctagcacagctgtttctcacttgggaaaactgaagccctcagaggcagagggaggaatggggagcggccaggccaggacaggactcagcccccagttcctcttctcaggcgtccgattccttctgatctttctctcctgccctctctgttactgcttcctcctgttcttacccttatatacacttgaagttttatccccattttttatgcttatgggattgtacactttctggttctctctcaagtccaaccagtatgtggtaacctgtctcttcccacttcatttgtggcactggtttgcagtggacaaaaggtccgtgctcctcttctaacctaatctggactgggttgcccaaaggttgccctgccacactgccaagtgcctaattagctgttttctctccaacccctccaaacacttatcatgagtaatttctcttgtctttagagttgccaaatctaatctctgtaaatacaaatgtggtgagacttcttctcaggagtttcagcaaatgaaacaataaactcttttttaccctgctaagattctaaagataaccatgagaatactcctaattatccttataaatttgaataagtgtggttgttgggttctctcaccctttttatatcccttcaaaagaaaatacaagtttgaattctataaaatatttttctggccgggcgcagtggctaacgcctgtaatcccagcactttgggaggctgaggtgggtggatcacaaggtcaggagttcaagaccagcctggccaacatggtgaaaccccatctctactaaaaatacaaaagttagctgggcgtggtggcgggcgcctgtaatcccagctgctcaggaggctgaggcaggagaatcacttgaaactggaaggcagaggttgcagtgagctgagatggcaccactgcactccagcctgggcgaaagagtgaaactccatctcaaaaaaagaaaaaaaaaatttctaatatttatggaatgcactctcttatataccaacatacatttgtagcattttttttccttcagagtatgaagaaatcagtaaaaatgggcaaagcacaaatgacaactaatggattttgttaagtcctatgtgtcactttaagaacttgaaactggctcaaataaaaaccattttatttggttattaaaatgagacttaaaaacttaaaacaagattttaagtgatcttaaaatgtcttatcctacagaagattttagaggcaatgtagtacaaaaagctcttccttttctctgaagaatttattgagtgctttgggagtagggtgagttttttttttttttttaacatatgtttgattcaattaagcaaaaatattgtttcatgtctcactgaactgaatacattctactatccattggttttcaatgttcacttatttattttattttagtagagactgggtctcactgtgttgtccaggttgggttttcaaattttatgtctaacacagtgtgctaaatacaactgagtttcataagccatttttcccacttctgtacatggcactggtctcaacctgtatcatgcataagaattacctaggatgcggccgggcgcggtggctcacgcctgtaatcccagcactttgggaggccgaggcgggtggatcatgaggtcaggagatcgagaccatcctggctaacaaggtgaaaccccgtctctattaaaaatacaaaaaattagccgggcgcggtggcgggcgcctgtagtcccagctacttgggaggctgaggcaggagaatggcgtgaacccgggaagcggagcttgcagtgagccgagattgcaccactgcagtccgcagtccggcctgggcgacagagcgagactccgtctcaaaaaaaaaaaaaaaaaaaaaagaattacctaggatgcttattaaaaatgcagattcccaattcctgaagggaggtcatgccttggcatcttacttagcgaatcagtgctatacagaaagtatgagagactggttcatatcaaagaatattgtgaaactctacactatatttgtgaagatatagaaaacccgttttatggctaaaaatcatcattttactactactaagcttcattattagtagatggagtttttttaaagggtcatttttcacaaagaaaaatttgttttgtcttttaacactttaggactgttacttcatagtttatccggggcagagaacaacagcgggttactctcaaacctgctctggagtttcagactagcagctgacatttttggggacctttctttaagcttgacattgtaaacactttgtatgtattaacccacttaatcctcaaaacaaccttgatgagtaggtatccttatcttacggaagaggaagctgaagcacagacagggttagtgacttacctaaggtcacagtgctggaaggtagcccagctggaatttgaacccagacagcatgtgggttcagagtgttttcatttttaactactctgctatattaccctctctagttttcagtattcatattagcacctcagccttccccagatgactacaaatcccatacatatgtgtatacacacatacccagggtcattcatgaaatctgaaacttcgggtgttcaatttgactttatagaaccttctacctctcctggctgatagtatctctttctcatttcacaaattaaacttcctataacactaccttaaacatgccacccctgctcaaaatactctggtggcttcctacgatctataagatgaaagctaacttccttagcttgccattcaaggcccttcacagtctttccagtcttactgtttattctatccctacttgagcacaaagcatttttttctttgatcatgcatagtccttctttcttcatttttttaagtgtacaattcagtggattttagtatattcagtgttatgcaaccatctccactatctaatgccagaacattttcatctctgctatctaatgccagaacattagaaaccctgtaccgcatagtggccattcccaattcacccttcctcttatcccctagcaaccaccaatctattttctgtctttacgaattagcttattctgggtatttcatataaatggaatcatacaatatgtggccatttgtgtctggcttgtttcatgtcacaatttttcaaggttcatctgtgtcgcagcatgtgatcaggatttcattgttttcttatggctgaataacattccattgtgtggatataacattttgtgtattcattcaatttgtcccaattggtggacaactgggttgtttccacttttggctattataataaagctatgaacatttgtgtacaagtttttgtgtgaatctatgctttcagttcccttgggtgtaaccctaggaatggaattgctgggtcatatggtaactgtgaactttttgaggaactgacaaactattttccacaagtggctgcaccattttacattcccaccagcaatgcttgagggttccaatttctccgtatcttcaccaacatctgtttgtgtgtttttgattattgccatcctagtaggtgtgaaatgatatatcattgtggttttgatttgcatttccctaatgactaaagatattaaacagcttttcacgagcttattggccatgtatatgtctcttttagagaactgtctattcatatccattttgtaaactgggttatctttttattgttgaattctaagagttctttagacatctgaatactagacttatgatttacaaatattttctcctattctgtgggatagctttttactttcttgatagtatcctttggtgcacaaaagcttttaattttgatgaagtccaatttatcactgatcataccagctggaaatctacttttttctatgtcagcatctcaatattacttgatgatctggggagaatttttgaaaatataaaaataatatacataaaattttgatataaaacaagagggccaagacttgaagaaatctggagcttctgttgagacgatgacctggggtcccaatgattactgttaggatcttaatgtacttagtggaaaggttgagaggcgctggcctacggcaggcactcctacagtaagactgaacctaaactgacattggtcagtttacttgggaagttgaccatatgttttttgtttgttttctcccaggctatagtacagtggcgtgatcttggctccctgcaacctctgtcttccaggttcaagcagttctactgcctcagcctcctgagtagctgggattacaggtgtgtgctaccacacccagttagtttttgtatttttagtagagatggggtttcaccatgttgcccagggtggtctccaactcctgacctcaaatgatccgcccaccttggcctcccaaagtgctgggattacaggcgtgagccatggtgcctggccgatggtatacattttaaaaataaatgtatgctatctaggagttcccatgttttgctattatttcctattctttcagagcaccaatagtcaatgaagaattaaaagtgaagtcagattatcctttagctaaagaatggggatttctagtagtacggttcaatatttttggtcagggccccatatgtttatactccaactttaatcaatcttttccacttctgactgagggatatgctgtaggaactttatgtgtactatttcagttggcctctgctggcttataaacagtagttgatatttagggacagtaatccagagtagtgtccaagtccatctgagtttagaattgctaccacagcagaaattggaaacctcgagagttataagccatttaccacatctacatggatgccacttctccttaaagcatatacaaatatatagagatcggaactttaaccttctgggatctaatatcttcctaagatttgcatacagaatgtacacatggatcttctattatagcaaattcttttttttttgagacggagtttttgctcttgttgcccaggtggagtgcaatggcgcgatctcggctcactgcaacctctgcctcccgggttcaagtgattctcctgcctcagcctcccaagttgctgggattacaagcgcctgccaccatgcccggctaattttttggatttttttttttagtagagacagggtttcgccatgttggccaggctggtctcaaactcctgacctcaggtgatccacccaccttggctttccaaagtgctgggattacaggtgtaagccaccgcgcctggccagcaaattcttaattgcctgtaaaattactatctcactatgtattattttcggaagcagatatgaccgtgtacagttttcttataaaagtgccatagcaacatgaatactcagtactgacaagcatctttaattgacaaaagctttttttttttttttttttgagacggagtctcactctgtcccccaggctggagtgcaatggtacgatctcggctcactgcaacctccccctcccaggttcaagcgattctcctgcctcagcctcccgagtagctgggattacaggcgtgcaccaccgtgcccggctaatttttgtatttttagtagagacagggtttcaccatgttggtcagaccagtctcaaattcctgacctcaggtgatccacccacctcagcctcccaaagtgctgggattacaggcatgagccactgtgcccggccatgacaaaagctttttatttttaatttaatcttagcctatggttaaagtgaagcatttaaatagcctacttgatgacttcatgtgagccaagaacaaaacctgggtctgataatcttctacctactctctgacaaactgtccctacaattataatgcaatgacatttctatgagcagcctctattactaacagttattatacacttggttcttatacagaatacttcattcaagatgtccagagcttcatctagctcactatcttcaaagcttctgcttgcaaagggaggaacttacaccatcagtccattttaagccaaaaggaaattcttacccagaaattaattacttatcctttttttagtgtgttactctccacacccccttcctgttttgaaagcagggagaaataatgatgtatacagtatcttctgaactatacaaattacagataagctttaaaggtctctaggaagctactactgtttcaccataagaactccaagtgggccctaaatctcctggtccttgacttcagccactgctaggaaaatgtcaatacacacacactcctatcttaaaaactctgtgcttgagaagaaggatggtttgctttgatattagactagctttccctggcagctgcaactagggaacctaatttttgttaaagctacaagtcac

SEQ ID NO: 12796 - DNA, 1499 bp, Homo sapiens
ccgagtagctgggattacaggtgagcaaccacaacgcacggctaattttttgtattttagcccagacggggtttcaccatgttggccaggatggtctcgatctcctgacctcatgttccgcaggcctcggcctcccaaagggctgggattacaggtgtgagtcactgcaccccgcccaggcctttgtctttctttaacgtgctgcttaaatccacgatgtgaattgtatgttagtgtgaatgttcccgagagtagaattttttttccttttgagaacctcagtggcattgcctgctcttgccctctctgggaaggacagcagaggggacactgctgtccctgctgtgacaatgtgcagtgatcacagggaggctttcaccctccaccctaacagtcagtcccagctgagccaacccaggatctggttttctgtatatcagatgcacgatgcacacaactgttttattaagcatgaaacaaaaccaagaagtataacagtgctttacagttcttctcttaattctggcctcgtatgatcttatcatgtattaacctcagaaacactacttttgcacatgtcagttaactgtacacaaatagtgccaattcctgccctgttgatgggagctggctttgctattagaggactttctgctatcgggggtttggcatgaaggtggtgcctgattagtttgatgatgggaaaaaacacagcaccttaagaagtacagaatcatagcaacgcagggccagtgggaaccacagggtcaccttcccagctcctgcattttacactgcagtgaagaagccaagtgatctgattgaggtcacttagctcatgagagccagagccagaggcctagatactcttccctcagcacagcaaaaaggtgactctgtaagatgagaggaccctagagattcatatcaagcagcataggatctgggaaatgttgtcttggcccctagagtgtagtgaaaactgggttttctggagaacaagagaaagcttcagttaagtcattctggtaaccagggctggcatcccgtgaagccgcgagcatagcaaacttgtgggaattttgtgttgaagaactcgaaggattcttcccctgccgtactgcaggctgcaggattgggatctcctttttctcatttcccacggtgaatacccccagcccatgtgccagtgggttgcataataaatatttggtgatgtatatatgaaagaaaggtgaagccgggcgcggtggctcacgcctgtaatcctagcactttgggaggccgaggcgggccgatcacaaggtcaggagatatctcaagaccatcctggctaacacggtgaaaacctgtctctactaaaaatacaaaaaattagccgggcgtggtggtgggcgcctgtagtcccagctactcgggaggctgaggccgagattgtgccactgcactccaacctgggcgacagagcgagactccgtctcaaaaaaaaaaaaaaaagg

SEQ ID NO: 12797 - DNA, 243 bp, Homo sapiens
tcacgaggtcaggagatcgagaccatcctggctaacacggtgaaaccccgtctctactaaaaatccaaaaaattagccgggcgtggtggtgggcgcctgtagtcccagctactcgggaggctaaggcagaagaatggcaggaacctgggaggcggagcttgcagtgagccgagatcacgccactgcactccagcctgggcgacagagcgagactccgtctcaaaaaaaaaaaaaaaaaaaatt

SEQ ID NO: 12798 - DNA, 243 bp, Homo sapiens
acgagatcaggagatcgagaccatcctggctaacacggtgaaaccctgtctctactaaaaatacataaaattagccgggcgtgttggcgggcgcctgtagtcccagctactcgggaggctgaggcaggagaatggcgtgaacccgggaggtggagcttgcagtgagctgagattgcgccactgcactccagcctgggcgacagagcgagactctgtctcaaaaaaaaaaaattaaattaaatt

SEQ ID NO: 12799 - DNA, 5775 bp, Homo sapiens
gccacgcgatccactgggcttctgggcacagaagtgcctcaacaggcacaggcaggctccccacagccacaaggaaccctgctgccaaggaagcagctcctgttggggtcatcagatttttaatctggctcagcaaagccatggctgtccagccttaaaaaaatgggtgatgtgggagaaatggagggtgtgtgaagagcacagctgggcctcgagaactcagggccagccttcccagcttgggtcctgtttcggagcccaggccttgcttccccttagccgccccagccagattcttttgcgccccctgctggcacacacaaagacagacccaggagcgcacatgtgaacgtgcgcatgcttgctgccagttacccagttcatgaacacgtgaagccttgacttcaggttaagtaataaaaatttattgagaattcctgggttggtgtttatctcctcccagccttgagggagggaacaacactgtaggaaatcactgagaaatcacgcactgtccccaacagccccagttaacacagggaggaggaaagtaattccccagaaaaggggctagtcttcagtcttccttaatccaagaggggttcagggaaccggtgtgggggaccatcgcatgatactggggcggggtagggctgtgctggacccctggctggctcctcaaaaactggagaagcagatccacttcctctgggggtggagttcttggtgactaggctcatttcttacccttgatgaggctgtcactgtaggaaaaaaaagatagataatgacattattaggggacataaatgtgagaggcaggacactctaggccattccctctacgaccctcctaccctgattgagggtttgtcttcggggaggtgggaaagggggtagggtaggaggcgggtactggagaaggtggcctgcaggaccccacagaagcaacaacagcttaccttcccctgtggtgccagatcgccagatgaacaagaaacagagaagagaaatgcacatgttaattgacagcttcaggccccactcagctttgaaccctcctttgctcccaagagaaaagataaacagggttgacagccaggaatctcaggctcatgaaaggaggaggcatgttctcatggccactgctatttctcatctcctttcctaacatccctccattcaccagaggagtttgagggctcttgagtaagaaaactgagtatcatctttcatcactttttggttagatgaaaactttataattaaagtgctttttatgtgaataatcctatttgatctcataaaatcaatcctatgagatgcaagatagaaactgtcaaccacccccttttctaattttggttcaatgtctctgagccatatgaatagctgtagcaggctccagagcccaaacaaccagactcaggtcccacgttcttggtgataccccacagtgtggccacatctctcacctggtgaaactttcatcctgtaggttcagcacaaggttgtcagctgtgagatagatacgattctgtgatgtggcgatctacagggcaggaaataagacagatgcttgcattaagcaaagacctcaattccgacccctgcaattcagcagctacttaacatggaacacatgcagattagggcaggggtgcagcaatgagtaacacatggtttctgctcgcacttagggatccagagcgctgagcagcagctatgattagaacaaaaggtcagggaacccagaggaatcattcttgacaggaggagtatcggagaagccaattttttatttatttatttttgagacggagtcttgctctgttgctcaggctggagtgcagtggcatgatctcagctcactgcaacttccgcctcctgggttcaagtgattctcctgcctcagcctcctgcgtagctgggaatatagctaaacgccaccacagcgggctcattatcttttgtatttttagtagagatggggtttcaccatgttggccaggctggtctcgaactcctgacctcaggtgatccacccaccttggcctcccaaagtgcggggattacatgcgtgagccaccgcgccggccagagaagccaatctgagtagaaaccggaacaagcaaggttcgaattccctcacctcaatgtgccttaactgaaagcactttctcaaggcagccccatcagagacgctgggctgacacactcaccgtcttggagatattctgggctgctcgaatcttgcgaagtttgatgtagccagggttcttgctcagtgcttctccaaggtgaggagggttaaggtacacgcaagggcaggtctcaatccctggccctgtccttaccacactcccttgctccagtcctcctctgggctgtcagatccaaggttgcgctcaggtggcttgtgcccagccctaccgtggaccccacctgtgggcctccctgcaggctgctgccaggaactaggggcagcaccagaaatgaaggcaaggccaccaatgctattgatctggccttacagtggggagtcatggctcaggtactaccactaagatttcagatctcatctgtagtccccacccccaacaaggagccaagggccagagagcacggagtcgcattcgccttagtctcatcagcctgcccatgaaggagaatggggaactcaggtgccctaggggctgggctgagatctctccagcagaaggatatcatcttggcagcctcggcctcaccctcggcctgcacaattttctgccgctgttcctgctttgctttttctaccaagaattgggcccgctgggcctcctgctgggctgtggtgggagagagtcagggagaccctgtcctgggtcaggagccccacccatggagtctttcctcctcctgcatctcagaagccctcaccccacggctcttgcgactcacccacttgtttggcttctacagcagctgtgtactctcggctaaagctcagctctgtgatggccacatcatccaggatgaggctgaagtccttggccctctctgtcagctcccggcggatcaacagggatacctgagggcaggggtgaagaggggaagggaggggtggtttgaggggactggggagctgaaaggaaggttgcgacccctaacccttcactctcaatacaacatgcactgccttagcttcctgtcaggcaaacctgtaacataagcctctctgctcgaagaggtgcaggaaaagccaagacttggccattttcctctgtgcttcctaacaccgagtgctatcgagttctaatgctggctctccttatttcacagtggcaattagcacagcttttaggtggaaatggcactagggtgacaatgcttttctaataagctgcctttcctaattcccaatactctgggcctaggaaggaaaggctgacaccacgcagatggtggtgggagtcagacctgggcccgctgggtgatcagctgtgaggcattgaacttggccaccacactcttgagcacctcgttgacaatggacggcaacactcgttcctcgtagtccagccctaggcgctggtacatgctaggaagctcctgagcattgggtcgagacaacactcgcagggagatattcaccatctgtaggtctgagattgaggtcagcagtggctggtcaaggccaaacaccctttcccaagcattttctccttcatgttcctccctgtatgccctgtgcaatggtgtacagcctggcactaccctggggggaggagagttaatcaggctgacaaggaagacaagacgcagcacagctgaaatgcaccctcacccactgtgaagccttgaactgcaaaccccgtcaccagcagagctgactactctttccccctctgtactctgtgcaacctctaacgtgggcgctttcgtgctgtaccgtaatcatgtctcctgtaaggacttgggggacaagaattgtgtttaatgaatcttttattcccagggcccagtctagtaaatgaataagcgacctgcactaggtatagcacaaagaagtacattacaggttacaggtgagctacctgacccagggtgtatatgtgtgcgtgggtggggaggaggaagaggtctggggaactcaaaggcacggcttttatgtatggtctagaaggagagaacaggtgaactagtcaagcttagggacaaacttctccagaacagagtgtactagtggatgtaactgtagatatagtaagtcaagcagttagaaaaaaaaggctttaaaacaaagctttgatctaggcagtgaacaagacgagggacaaacaatactcttattgaatacacgtcagggaggagacagtaaaaagcacgcaaacacagtgtgttcagaatttgctgctttgaccccaggaggcaggtatttttgttacagctcttgcagatgtggaaagaggcctaaaggcctgacactaccatattcccctggggtttcttgccagctaccttgatcatcccacctgccatgtgattaccaagtgctcagacctacctttggagcctgtaggggaggagatttttcgaggtctggcccgaatgtcatagataatggggtactggaaccaagggatcctggagaggacagggataggtattaagaggccacagtttcggccgggcgcggtggctcacgcctgtaatcccagcactttgggaggccgaggcgggcggatcatttgaggtcaggagttcgagaccagcttgatctacatagtgaaaccccgtctctactaaaatacaaaaattagccgggcgtggtggcgggcgcctgtaatcccagctactcgtgaggctgaggcaggagaatcgcttgaaatcaggaggcggaggttgcagtgagccgagatcgcgccactgcactccagcctgggcgacagagcaagactccctctccaaaaaaaaaaaaagaaaaggccgcagtttcactagccttgcccggtttcccctcaccacgcgttttttggcctgctcctctccacgaccacagacaaggagagattctcttgtccctctggaaaacaacagtttgtatgctgctggaggttctcgcagcacccactatcctaggggcagggatgaggagggtgggaaaagagcagcgttgaatcctgttgcacgtccgactatagccactgctgggtcggcgtcaagggtgaaaggtcagggtcagcaggctctgcccgccattacctgaagtgaaggccctcggccaggatagtgtcctgctgcactccaccgatccgattgaagaagatggctctgtgcccgccttccactgtggggagatgggtggtgatcaggccaggccgctgctcagaggaaatgctaggcccgtggaggggcgcggggacagggcaaggggtttgggggagggactggaagcgtccggcgagcaggcggaggttgctcaccggtgaacacagattcgcgcacaccgtaggccacggcgccggcccccagcaacagcttcagggccgtgcccatgccccggggcccggcgggcagccgtcccgccaagtccttcaagttctgggccatgtctgatcttgaggccggcggcactggaggtcagaagggggtgccggcccgcctctaccccgctccggcttaggtactgcacccttcacacgagggttcgggcccgtaaggctggcgaaagaaagggcagcggaagtgcgctccctttgaaaccctcccccttagcccactacggacccg

SEQ ID NO: 12800 - DNA, 738 bp, Homo sapiens
ccaaataccattattgattgattgattgactgactgagacaaggcctcactcctgttgcccaggctggtgcagtgatgtgatcatggctcactgcagccttgacttctggggctctggtgcatcctctcacttcagtcccctgagtagctgggactacagacacatgctaccatgcccagctaatgcaaatatcatttttaaaaggcgactgaactggacgcctcatatgagctcccatggctgcccagacatgctttcatgtcagtgattatataattttttttgtaaattagcttatgcaaataatcttgtggaccctaacttatacatgcttctgcaaagaaacatgtttaacgataaagttatactggaattcaaaacatgatgttttatggaatgtaagacattggggtatagataaaaagtggttggaaaaaatatatatatttatttttagagatgaggtctccttctgtcatctaggttggaatgcagtggcatcatcatagttcactgcagtctcaaattcctgggctcaaatgatcctcccaccttggtctcctgaatagctgggactacaggtgcatgccatcatgcctggctaattaaaaacaaaatttatttatttatttttgagacagaatcttgctcttttgcccatgctggagtgtagaggtatgatcttggctcaatgcagcctcaacgtcctgagttgagcggaggaccccgggctccag

SEQ ID NO: 12801 - DNA, 330 bp, Homo sapiens
gggaagctacagccagcttggtaattgacagccctgactatgaccttatatttgtgtctcctttttccttatttcactttttttcccctctcagccttgttgcccagagattgtacctcccaacaaataattaattatcactaaggtttgccttggcacatccctttggcggctttgccagcagacgcaagcaggtaatgtgaaccagacaccgtgctaggtgtgggacatcaaatggtgaacaagacagatttttgcccgacccttatgcagttttcgacctagtgagagagacaggccatatgctattaaacaacaataaacagaaaa

SEQ ID NO: 12802 - DNA, 330 bp, Homo sapiens; identical to SEQ ID NO: 12801

SEQ ID NO: 12803 - DNA, 330 bp, Homo sapiens; identical to SEQ ID NO: 12801

SEQ ID NO: 12804 - DNA, 30904 bp, Homo sapiens
ttcttaaacccaagctgactttaatgagaattttaaaatttttaaataggtctctggcaaagaacaatgcaggagtaaggatccaggcacagtccaacatctccctgaggcctccacacaggcccctcaaactgcacccattctgaccatgcaccactttccacagacctggtcccacagccgtcccttcatttggggaagtagggaagggatggctttgggggatgcagagcccatcctcagccctgccatctgccccacttcttaggacttcctgggattgtccttcccttgactctcccatccctctggtcccctggtctcacacagcatggcccctcccaccctctggcttctgctggttctaaccatcttctttgatccctagtgccacctccccatggtcccccttagccacctcagccttgccgtccttctcaggtagagccctctgacttgaccccagtcttgtcagtccctactctagagagcccacagtcccagctccctgaggccccgctcttctggacctggctgtacagggctgagttgtggcttttgatgccactgccagttgcagtaccaggttcagggaaggctgggccctggggcttgggagcaaggaggggctttgtgctccgagggggtggcacagcgtagtcatcagtggcagggttgtaggggagctcatagccctcctccttcacccgagcttggcaccaccatgcatccttgggctcccgaggcagatcataaaggccctggggagggactggggccaggccctcaggttcatcatagatgggatcctctttggggtctgtcagcttggccttcagcaactgctgctgcgcatgctcatacaagtcccaatagagaggtttcttccgttgtactccctctcctgcctgagcagacgtgctgtccaaggggtctgagtatagggagtcctgggaagggcatggagcaatgcgcagggagtctaagggctcagcatacagggctgggggactgtcgaggagctcttgggggccaggtggggaaggcaacttcccctctgccacctccccttcatgggagtcagctctgagaacatcgtgcccctgtccggcctttccctgggccttctgccggtggatggcagtctcaactgcctggaagatgtcatttccctgtgccgtctggaaggtgaaggttccagggcctgaggggcagcggcggccggcctcgaaagagaacatgacctaaggagggtagagggggaaacacattaccaggagccatcagaggaagtgagtcacacgcctgcactagttagggtatctacaaagaagagaccacctgcgaacagacgcggggtcaccgggtaggcaagaaagggggatccaaaggtcagagcttcccactttctgtcctgccccacccctcccacagctgcccaacccaggaagccctcccggacagcccctgcaccttgtcccggccatagcgacgcaacagagtgtagggccaggacaggagtggctccagtatctgactctgggcccccacggtcaggagagtcagcctttcagcctccaccctcagcacgtaggagccatgcaggccacagcgctcggcggcctcagtcctctgcaccgttacccagaattgggatcctggaaggcatacacgattagacagctgcgggggagggacgggggcagcagtggggacccagaggactcatgagcatagtgtccaagcactcactcggaagccagatctcagggccttcctacttcttacttccccatgggcccctgggtatccacccacttcccaaaggccctcggccctcctcctcttcactccatccctgcccgggcttctgaggcgtctaccttcccaggtagggctgtacaaggagttctccagcatctccagggcagaaagcttaggtgggttatcggtaggcgccagagtccagctgcctttctgtagtagagagcatcgagaaacccgtaatttcctcagcggggagcgggggtcggtctgaggcagccccatttctctgcctctgtaactgcccccaccccgcatcgccgcagctcctcaccggaaaggcgtttcggcacagcgtctgcacccaggctgcactggacggcgcgtcggccgccagcaggtgcgagcgctgagcagtgtccaggcggaaggcagtggcgccgggctcagggggggtctccacggtgacgggggccacactcacacactcagccagacggatcactttgcagtccaggcggcgcgagctccctcggccacccccagagctcgaccccttatggtcaaagaactcgagccgcgctacgccgtggggactggccgggtagagcacggcccaggtcttcctccacctctagggagagagagagagtgctcgagagggagtggcgtgcgcaggcggcccgggtcccgacggggaaggaggttgcggcgcaagtcgatttgggatctggggcttccaaacggggttgggggcgaagtttcccaaggacgatgccactccgtctccccaggaccagaacccctagactacagacgcttcccgggagtgtgcaaagcaacttcacgggaaagtcacaggctctccaactcccggcgccgctctccagcccgctgcccacctctccctgtttctgggctctctcacccactactagcccggataaggttcggcatccatgcgccagactaccttggtcccaaagcgctgactctgcaaaaaaagcggcccttccatcactgctccgtccatggcccccggcggttccttccgcgcttcctggccctgcggcgggaggcggggcgggaggcggggccgggttccctggaggagtttccgcccctccccggcccccgccggcagccgctgggggggtcgcggtggggtgagggagaggagcgagaaggaatggtggagacccccggattagccgggagctgcagcaccccaggcccctacccgccgtcgtgggggcgcgccagtggctccaccgaaagtcctcggttttggcgcgagggccctggcctctgggcgtggtggctgcgcgtgacgtcatatgcccaaggtgacgtcagagtgaaagccatgacatcaccccgaaagcgccccgggcaccggagagacccacacgggcctccggggctttatttaccctggccgggcccgcccccagccccgcccgagccgggctgtttagactccgctggcccgggactcggagggagggctggggttgaaccgcttcccgccaccaccggggccgccccgccgcccggccgccgcttgcatgtcagctccctgaccgcagaggcctggcctccatgccgcgggaagagaaagcttcattgaacgagccgggagggccagggagggggagggggcgcggcagtggccagctccacggggagggaggacccagaggaggagaggagggaactggccgggaggaatggaaggagaaggcggaatgtgggagggctcagggggatgtgggagggacgaacggagaagggggagagaggggggtccagtctcccctggccgagcatttttttttttttttggaagtcctaggactgatctccaggaccagcactcttctcccagcccttagggtcctgctcggccaaggtagggggagtcacgctaaccgcagagggaatgagtaggggatggagaggatgtggagggaccagggaaaacgggtggtgtgggatggagtcgaggggaagccacccaactgagagtttgattcttgtcaaagggcaagtgagacagagtacacggaggaggcacataccggaggcgggggctacgggtgttcgaacagggccgccaggagcgccctaagggagggggctcctccgggaggcgctgcccctgggtccccaacccagaacaaagctgccttgttggattgattgtttgggttgggggaagcatgttgacgggggcttgctgtagaggggctgttctcagccctaggcagagaaggccttggctgaggagccatagcgcctggcctcccgttgcccggtgacagggatggtggtgttggcaggaggctgggacaaccctaccccatcccccgcccagccttgaggcctggccctcctgggcctcttgaccctgcagggcatctgagagcctgcgtgttggggagggcgtgcagcaggttctccaggcgagctttggtgccagccttccctgcctgggaatctgctgggttaggactctgggctcccattcaggggatctgtgatcccagggccgcctagggccccttacgtgcctctctgcacaatcagtacagctgtctgtcctccctctgagtaaatggggtcatctggatccctcccacgtccgccccttggctcttgtcaatccctctccttctcacccgcggtgtgcttggttcccctatactgagtgcttagttctttgcctatcactttctatccgttgtctctctcctctgtgtctttctggttttctctctctcattcccacagtctcccttcctctcacatcctgtctgtctgggtcttcctctctctctacgtgtctcttgctcagtctctatctctttttattgacccttctctgactctcgatctctcatagttgtctcttatctctgggtctctcaggctgtgcctctatgacctgtgcctcagcccttatttaatgtgtttctctccctgtctcttggtccctggggctctttctctcctgttgtctctcgctgtctctgtcttactcagtgtctgtttttctttcgtgacttctccctctctttctgactctgggccccactcaatctgtttctctcacgcacactttgtctctggggcacccaggccttccctgccatgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggtgagcaatgatccaggcatatcctagatatttcctatgtgtggccaaagtgcagggaaagggaacacgaggatggcacagccatagggacacacgacaccaagaacagccagcattgagtaaatccatggatgacaaaccaagcaacatagttacttcccagagctgtgtgaccttaggctagtcagtgctttctctgagcctcagatgccctgtatgcaaaatgactagatgatgtctaagttcttttctgctgcaaaagtatgatcctacaaagccatccacaaaacagcccagatacaggtgagccctgtacaaataaagtacagttagtctcatgggacgctaagagcaggtaaatgatatctggatgtcccaaagtcacaaggggtcacagacactgcagctaacaaaatcaggttatgggccagagctaaaactaacaaggtggtactgtctaaggacaagtataaaatctaggacaagtatgagtgtgggtggtggaggcttaagagcagttccctaggtgaggcctaggactgtgcccatggtatgaacccacagtgggaatgatggacagaagcaggtgcaacctgcagctgattccccagttcccactggctagaccacctgtggaattaagtgtcatttgtagatgctgtgttttaagagggacagtagaaaatggaaatactttcagaggagagctgcctagatgtgaaagattcagaagccaagtttcaaggaggaattgctgaagaatcaggggattgatatggaaagtaaaaaccttgcatagcaatggcgtaatggttgtttttaaatatgggaaggacagtcgtgtggctgaaggatttttctggttggcaccaaaggaatgaatcagatgtggtaggggaaagtcatgaagagtcacaaggactttgatggttacacagtctggtggggcaggagctaggtgtctccgcaacaactgggtaagtcctgttgggatgtgaatgagatgtccttgaacattggctaggacagatgacctttgaggctgcgcccaattctgagaggaagccagtgatactccacagggttcaggccgggctcagtggctcacgcctataatcccagcactttgggaggctgaggtgggtggatcacctgaggtcaggagttcgagaccagcctggccaacatggttgaaaccctgtctctactacaaatacaaaaattagccaggtatggtggcacatgcttgtagccccagctacttgggaggctaaggcaggagaattgcttgaacctgggagacagaggttgcagtgagctgagatcatgccactgcatttcagcctaggcaacagggcaagacttcgtttcaaaaaaaaaaaaaaaacaggtttcagacagagagaagaacaaggggctatatggcagcacagacagggcgggcacaagagagaatgcaaggatgtgaagaaaggatcttagacatccaagcctcacagatagatcaaactcctaagcccccacgtattggctttatggtcttaagcaagttgctcagcttctctaaaccccagtttctttatataaaacagtgttctggcagctctgttctaagaatgatcacatatgtgcacaccatggcagagcacctggcacacagtaggtacctgattaattgtagctatcaatgaatgggtagagactgatcagaacttcagggttgattcttggttttttattcaccgtatcaggttcttgagtatccccagatcacaccaattttccctcaatcttatgcccccttcctattccctgccagggtcccctgtcccgtctccaccccttatcataccagaaagatgggatcatcatggccaagtgggaggcctcagcactcactcttccctacatccccattactcccccatcctccctccccaagcttctctgtcccttcatctccccttccacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggtctgcatttcctagacatacacacacacactacccaggatagccgagagtactgtggggtggttagcggagacattagaaggtagttacccctgggggatcatttggattggtgggagacttggaaaagcaaatgatagagctcccagatgctgtaaaatccaacaggtttttagcattcacattcaaggggctaaacctggcatgagcctctccagcttcatccctagtcacccctggggcacctggtgctctccttctcctcaaatgttcctgctttcctgagacatcttccttctgactttctcctccttcaaagccatttcctttttgaagtgctccctcctgctccaggcacagggagggcctccttcctagtgccctgaatcctctctgggagcacagcacatcccacgcgctgctggctgcaagagagtccacaccgcggactgcggccatcgtggccgctctctcagcgccgcctcgggcccatcccgccactgggtttacagcaggcacaccaagcagggttccttaagggcggcgggacacatgaaaggtgccactgggattctttccctgcttgtggccccgcccccaggtagagcatcacctgcaagtggaggaggtgcgaattcgacccgccgttgggtggggcagacgacccctgcccgtgacggaggggctggtggaagtcaggcttcctgacggctggtcgcaagtgtgcgacaaaggctggagcgcccacaacagccacgtggtctgcgggatgctgggcttccccagcgaaaagagggtcaacgcggccttctacaggtgaggggccgcgggcgccgggcggagcaggccgggattggggtgctccctgatgaatagccttgggagacatctgagcaggtccggggcacgggaggacccgggggtcgggacgcgcgggaaaatatggaggccgttgcaaagctggagagttgggaaatcttgtgggaccacgaaaggtgccccaagggagtacctgaaatggggaccagcgaggctcccgctctctcgtggccgacgcctgggcgggcaggcggattcctcggccccggggcgcgcgccggcctcgcgaggccactcccaggcgcgggggcgattccagcgctggcgctgccggccagcgatttccgagttcagtaaggacgcggccgcccctgggaggcggcgcctgggtgtgtcccgcgcaggctgggcgcccagggtccgggggcccggggacggcggcgcgcgatggccgaagggcgccaggagagaccgcgccagtctctctgcccgggccgccccggggcggggcgcgtatgtgaacgctcgagccctcggggctcctggaagtcctggaagtttcccaggatctcttttggcgaggcccaacctctccacctgcgctggagccctggggtccagtccggcttccagggaaacgcatcaccctggaaactgcctgtgcttaacgtctcccttccctggaacatctactttgatctttttgagaaactgccattgacagccaggcatttatttggaaatctttacaccctctcactgtaatctattttgcgagccaaaaatcctccctttcttcagtggttccctagatcagtattgctgaaaggcctcttgatgtccggataggtttccgcgggcacactacttcagatggggtctgatgccgccagctactgtagaaatcctcaaccccgactgaagcgtgctcggattacactgtcttcctactgcggcagcttcccactgcttatactgaacttgtcatcacttaaaaccagttcaggtcttccctatgcttcctactgatagagcagccttttccaacccaggtataggtgacgtttacctattacatttgttttgatacataatttagaagccataaaaaagccatgatgatcccatgagattatcttgagtcctgatgtgactttccatctgtcatttcccctcagcctcctctgctgaacagacatggcagctttgccttctggcttcatccaaatggctaaaagttgttgtggaaatgtttaaaaccaaagtctaactcttcttgcaaaatgttcctgtagattttcatcaagcttctaatcatcagctgtaaaatatgttccttccaccaactgggaagaaacagaacacttcaatgatgtaaccaacatttcaccttatctatctatatatttcttatctgtaatgaaatcatgggagattctgttagtttttgataaaatccagatatgctatgttcacagccattctccagccttccaatttagtaatcctgtcaaaaaagaaaatcatagtagtttgagtctatttttactgaaatccttttaggtctctaagaatcaccttattttttcctaaatgcttacaaacttctatttaataatttattctagaatattacttatgtgtagattgaggaattgaggaatcctttttctccttttttttttttcttttgaaagtcaggatattatccagtctccagtcttttctatacctgctcacactttctttgccttggctctgaggctcatctgaaatgtctttcagtactgaggactttcggtactttatctggcctggacactcaaaccactttaaaacaaacgtgctgtgcctctttactttcatccatcttggggctgcatttccttctctgtgctgcttaccttccctaatttaaaccccatgttctgaaagatgcgtagaatttagacatttccagtgaagaagatagcgtgaacaaaggtgtagagatccactcacccaatatttatttactgagatcttactatgtgccaggtactgttgtagacactacccgtggctcatgcctataatcccaggactttgggaggccacggtggaagcattatttgagcccaagaattcgagaccagcctgggcaacataatgagaccctgtctctacagataattttttaaaaataaaattagctgaacatggtggtgcgtgcctgtagtcccagctacttgggaggctgaggtgggaagattgcttgagcccaggaagtcaaggctgcagtgagctgtgatcatgccactacactgcctgggtggcagagcaagaccctgtctcaaaaaataaattaactaaggccgggcacggtggctcacacctgtaatcccagcactttgggaggtcgaggcgcggatcacctgaggtcaggagttcgagaccagcctgaccaacatggagaaaccccatctctactaaaaatacaaaactagccgggtgtggtggcgcatgactgtaatcccagctactcgggaggctgaggcgggagaatggcttgaacccgggaggcggaggttgcggtgagctgagatcgcgccattgcactccagcctgggcaacaagagcgaaactccgtctcaaataaaaataaaataaaaataaattaagtaagtaagtaaataaataagtggtgaaggaaggcctcttggagaaggcatcatttgagaaaagatttaaaggaggtgagggcacaagctatgcagacctctagataaacatttctaggaagagggatcaaaaatgaaaatattctggggtgtgtgtgtgcctgtgtgtgtatgtagtgggtgatgggataaggcctctccttctcctggaggccactgtggctggagctgagtgaaaaagaagaaaatggtaggagatgcagtgtaggtggtcttcggaaaagaatgggaagccagatcctgcgggccatctgggagaggatggcttttgttctgtgggagataaggaaccactggagggcttggagcagaggtgtgacatcgggcttccatttttttttcagtactactttcactgctttattaggaatagattgtaagggatgcagtagaagcaagaagtcaggtggctggttatggggttattgtcttctgaaagccacgtaaagaaagtgaaaggtgatggtgaccagtgaaagtggtgaaaaatgatcaagatttacagacagttgaaggcagagctataggacttgctgatggattcagtgtgatgtgagagagaggagttaaggctctctccaggtttttggcctcagctaagtaagaaattggcctcacctgacaaggaaaacagtgaatggagcatgttttgttgggagatgggcttgggggtggagggtaggaacttggttttagacctgttaaatttaagattctttaagacattgaagtggcgaggctaagttaggtaatttaatataggactctggagttcagttgagtaaaacatataaagtcctgaaactggacaacataccaaggaagtgaatgtaaatttaaaagacagagagaggcccagagactgaaccttggggagactaaatatttaaaagtcagaagataagatgaatgcaaacagtgaggtgaggtaggaagaaaaccaggggagtgtggtggcctgggagccaagtaaagtgcttcgaagaggagagagtgaccagctaagtcagtgctgcccagacctaaaaacatgaggactgagaaacaaatgctggatttagcaacagtaaagtcactgttggccccaacagagatgataatgaatggtttatatttggaagacagtaagttagcaagagtaggtttatactgagaaatagtggaagatctggataaagggaggccagaaaatggaatgctttaggtgccaaattggagagtttggcctttgccttatagaaaaattacaaataaaggtatttatatgggacaagaataaagccagtgtttttgaaagtttgcctgatagtagtggatgaggagaggagggtcttgatgcagtaagaccagtcaggagtttgttctaaaattgaagcttatcaggagggtaaaaacaaagatggaggaaaatgaatagatgtaggatgactgatagaacatagagaatgagagaacagacacctaaaatgattccgatgctgcctgagagaaggatggtaccagcagccatctctgggcttcaggttaatatgaactagctttagagatgggctgtccttggaaagtttgagacacaggaattgtccccaggtatgcaaagctgaaataagttttagggatcaggaatatttgttggacatatcggaatctcatactaagtctgggatataaaggctggagaaagagatacactaaagcacagaggccattcttcgtggggaaagagattgcgggagccctgggagattctgtgatggggctatgatctagatccttcacaggtcaggcccagcagagggagcattctcacaggtgatacaattattacaattatgaaagataggcaagacagttgtaaacaactctcccctccttagggaaaaaaaatggatctgctggcttttagaggaagtcagtaagatttagggaatgagaaaatcaaaacctgatgtattaatcatttttcaatttgttttggtagttctaccctagaacatgtaaaagttgtagaactttagaataagaaaagaatgtacagataattgaactatttactactcttttacaggtaatgaaattgaggctctaagagcttcagtgctatttaagaagtcactcttctagttcatttcagcttgacagatgtttattgaactcctatttgccaagtactgtgcaaggtgctgagaatacaaaggtgaataaatgacaagagaggttattaggctgcagatcatagaagaccttataggccatcataaggattcaggtccttatgataaaaggattgggaagcctttgatgtttggattgtttgtttgtttgttttgtttgtttgtttttttgagagggagtctggcttgttgcccaggctggagtgcagtggcacaatctctgctcactgcaacctccacctccctgggttcaagtgattcttctgcttcagcctcctgagtggctaggtctacaggtgcccaccacgcccagctaatttttgtatttttagtagagacgaggtttcaccatgctcgccaggctggtcttgaactcctgacctcaggtgatccgcctacctcggcctcccaaagtgctgggcttacaggcttgagccaccgtgcccggccattgaagtgttttaatggggagggctatgagatggcatgatcaggtttgtgactccaaaagatcatttgaatctatttcttttttttcttttcttttctttttttttttttttttttttttgagacagagccttgctttgtcacccaggctggagtgtactggtgcaatcttggttcactgcaacctccgcctcctgggttcaagcaattctcctacctcagcctctcgagtagctgggattacgggcacgcgccaccatgcccagctaatttgctgatttttgggtatttttagtaaagatggggtttctccatgttgcccaggctggtcttgatctcctgacctcaggatcagatcaagtgatctgcctgtcctggcctcccaaagtgctgggattacagctatgagccaccacgccccgcctttgactctatttctgagaataatcaggagaggagcaaaagatatggattggagagatatttagaagtaaaattgacaggacttggttattgattgactttgggatccaagaaagggagaagtcaggattgacccctaggtttctggagtggattttactgagataattatcttttttttttggacctacattacatttcagattactttcagatctctacctagaaacatcaagaaggcaatgaaatagacaagattatgaatacactaggtgtgaattagaccatatagagggccctatatgaagtgagaacaaaatgcctaagaaagagctccacaaattttaatgaccagataggggaggagcctgcagagaagaccaagaaagagcaaccagaattaggagtaggcggctctaggcacactgcctaggagtcagccctgctccctggggagccactctggaaattaataataataataagcagaattaggaataaaaccaggatattgtagtgttatagcagccaaggaaagagaggacagtcagatgttgcagagaggtcattaagatgaagactgaaaaatgtctgctggatttaacaaaatagaagtttgcagagtgataggtagggaaaaccagaggaagtgggttgaaaaatgagtaagaggaggctgggcatggtggctcacacctgtaatcccagcactttgggaggccaaggcaggtgaatcacctgagatcaggagtttgagaccagcctggccaacatgatgaaactccgtctctactaaaaatacaaaaattagctggctgtggtggtgcgtgcctgtaatcccagctacctgggaggctgaggcaggagaattgctgagcccaggaggcggaggttgcagtgagccaagattgcaccactgcactccagcctgagtgacagatcgagactctgtctcaaaaaaaaaaaaaaaaagtaggaagagaggatataaagatgataagtatggacagctcttgagaaatgttactgtgaaggggaggagagataagtagagggtgtgtgtgtgtgtgtgtgtgtgcatgtgtaggagtgatttgaatgtttaaaaggattcagttgagaaaaagaaatggtatgcaggactgagaaaaattgtaagagatggaatttagaaacatttaggtacagtagacttagagaagaaaaatagttgaaaggtatgagaagaggatatgcaaatgtagacaggtttttgttttgggttttttctttgtttgtttgtttgtttgtttgattccttgtttttgagacagggtctctctatgttgaccaggccagagtgcagtggcgccatcatggctcactgcaacctcgacctcttgggctcaagcgatcatcccatctcagcctcctgagtagctggaactacaggctcgagccaccacacccggctaatttttaaattttttgtagagacgaggtctcactgtgttgcccaggctggtctcaaacttctgggctcaagcagtcctcctgcctcagcctcccaaagtgctgggattacaggcgtaagccgctgcccctggcctacataggtttttatgtttgatggctgaaggaaggaacaaatggtaggtggaaacaaacacatctgtgaatgaagaaatttaaatcaagacaaataacagcactggtcctcaatgaggacaaagtccttaacataacttatatataattttatatataaaatatttataagataaaagggtctaaactcttttatataaatatgaaataagattacatatgtttgtgtatatatatatataaataatacaaagacctgttgatataaggtccttaaataatttagagaagaggtacttctaaatttctagataataccaaaatgttttagtactactctggagatcaaggtgaactctccaggttgattggtgaagaggccaagtgtatttcattttagacattttagacatgtttgagaaaaagacatttggagaaaaaatttcacaccatatttataagatgaaagagtctaactattagcaatgtctcagtaaagggacctgagagttgtatattctttgccaggaatgtccaacactttggacactttggcaaagagaccaactaagtacatcctcaggaagaagctgaggcagaaaatatcaaacagcttctgactggtttaaaatatatacgtatatttaaatcccaaggtgtcttcacacattaaacagtcatccctcagtaaccatgggggattggttctaggatctcccaaggataccacaattcaaagatgctcaagtccctgatataaaatgctatagtatttgcatataacctatgcacatcctctgtatgctttaaatcatctctagattacttataatacctaacataatgtaaatgctacataagtagttgttatattttattgcttagggaataatgacaagaaaaaaagttggtacgtgttcagtacagatggaggttgaatctacagatgcagagcccatggatatggaaggccagctgtactatgttgaaatatgactcctcaagagaaacagcggagcaggaacatgttcaaagaaaggacaactaaggctgggctcagtggctcatgcctgttatcccagcactttgggaggccaaggcaggaggatagcttgggctcagaagtttgagatgagaccagcctggacaacatagtgagaccctgcttctaacaaatattagccagtcatgatggtgcacacctgtggtcccagcgattcagaaggctgaggtgggagaatcacttgagcccaggagataaggctgcagtgagccatggttgcaccatggctcactgcagcctgggtgacagagtaaccctgtctcaaagaccaaaaaaaaaaaaaaggaaaaattatttatttccctggaagtaagtttgggagatgaactcagtttgtgaatgaccacagcatatgggattggaacttcagcaggaagggtggtgtcattgtaaggagcctggcctgtgttccccagtcaaaccaagttaacgcccttggatattcggccttggttcttggtcctggtccagcggcctcaggcctgaacaatgccagagtctttctcaaagagagcatccaggaaaaaaagacacagtagcctccctaggcctgactcaggctagttctgccgcctagcctggtcagtctggcaatcttaacaatcctaacgatgctccccttagccctccactgaggtttagcactaacatctggactcaggagtccttacttgccatctgccctagctaatttctgagggtgctggcatgggggcaccgtcctgagtccacggccttcacttctgctcacccacctggtcatgtgctgaagaggccaagcagctatgaaagcttgggtctcagccaggtgcggtggctcacgcctgtaatcccaacactttgggaggccaagacgggtggatcacaaggtcaggagttcgagaccagcctagccaacatagtgaaaccccatctctactaaaaatacaaaaaaaagaaaaaagaaagctcgggtctcaggagtgtctgctgttataatatcctgccaccaggaagccttcggactgctagaagagaaatcttgcccctggtcctagttgcaccagcttttccacttggttctacactaaccctgactactgttgtcttatcctcacagaaagttgaggaagcgagcggccaaggtctcagcccgacaccccaagccccttggaaggtatggggcaagagccccgggacctcctgctcgccctgcggccccaggaggtggatggatggatggcagccatccatgtccatcccagaacccaagctgatggattagggatgtgaggaaaatggcttttcctgcagggaggtgaagggagcaggcatggggatgggcaagctttgatcttagggaacacaaggaggaagtaatgtaggagtggctgagaagcctcccatctttacacctaccccaaatagcttggattccagcctcagccaccttcattcttcctccttcctgccccctccatcacctcccttagttcacccacattcccattctctcccctctccacctttcctcttcccttctccccttcccaactcccccacctggattgacatcgctagatttcccattactgttgctgaatccagagagcagcatgagttcctgaaatgcagttcaatggtgttcagcagacggtggatgcggaaaatcttcatttttcccatccccatgctgcccacaaagggtctttcccagaaacagaaaaataaccctgtacctttcctgcgccacatatgtaaccactacctctaccaacttccttctcctttttgcggaccaatcaccaagcttaaagtcaaacccaaaccccgagtggtcagggggccacacaagaggtaaataaaattcaggttgggtggaaaggagagggagcatggagttactcggctgtggccagggagggagggggtccaggaggcctttgtggctgaaagagctgaccaagaggaggagcagcagcagctcttagaaatcaccttccagggcatttactgaagtgttacgcaagactggtccttaccttggtctcaggaatgatgcttgtcctaggatttgttttttcactcactgactacctcgttccacatgtttacttatcttcccctgctgagttccaggagacaacatggtgcttttctctttcagacgccatacttgcgtctcctgtaagaggttacatttgcctaaaggatcagtgttcccaaatcaaatgctttatttgattagttgttaaaaataagtgctaccagcttactcgagatggagggaaactcagcgtcccctttggaacctttaccaggaatgcagtcagattgacagcccctgcctctctggctcattttccacaattaggctcccagttccctaattttcctcctgggctcctttagaactcgaagtgggaagcttccaacccctgtaattacatctaacttgtcttcaaaaggcagtttgcacattaaaagtctccctgataacttcaagagggactgaagtatcgataattcatccctttctcccctcctgttctcaacaagttctagtctcacccagtggtcccctcatagccctcattccccagcttctctggtggtttcaaaggatctcagaaatttggggatgttcttgtagtgcccttctagcttagggtcatctttgcccaacatggccacactctagccttccctgacctgcacattaaagtacacactgccatttttattttgttcattgtagacaacgggaatgaggatgtttagaagatagatgtatttttcctgtgatgggctccttgacttttactttcagccaaacaggactgtgggagagtgcctgatctcttagatcttcaggatccatttatcctgagcttccaaaggtattctgtaaagtctccaggcttcctttgtctgttttgtgtataaacttttcctcctcctgtgtcttcctagccaatggcttcaagtcatcatattccatccttcctctgacatcaagtgatagggcacattattgcaataatgcatgactacatcagcctcacaggcccgttccaccagcaccagacctcattttcttccctttctctgcgggcagagtgtacttcactctggcacgtgcctcactgcagcctctcattctactggtatcgataaagaagtccccccattctctcaaacatctcggcagcatttccaagccttagcatctatagttcagtcccattatcctattcagatggctttgggacactgttacgttgaaattgcagaagcatggactgcctttttaaagacttacacagcacaggtcctgggatgtctttgccattttgttgttcacatccatctcctttctctggtcatttattccctcaaactttgacctgtcctgcatttatacatcttcattcttgcatatgccagtcccagtttttcttgcgtctacctgctggtctgttcttgctgcatctgcccctcctaatctgtcctgcagagtctctggcctctgcggagctatggagatgggagacttccttagtcctttgcatcctgactcattcagttattccagtctcagcatcacagaaggacttgctcgccctggcttttcaggcttcctgtgtcagccactccctcctggccatttcttccaactggaaagtcctggtttccccttccctgaggccttagcctcagcctcctttagggccagcagcctgaaaccacttggaacagtttcttccaggcaagtcgagactagccatccttctcttaaggttgttctactgcaggaggtccccaaggcccctcctatctgggtagttgaggctccctcagcctggaaactcagcaatccccatgtatctcccgagggaaacatggaagggggaagaagaggagataaatggtcacaaaagggtggggggcatggtggaggcatgaagtgggaggatgtttgtggggccaagaggcaggagcattgttttaccctactgcacctcactcctgtccccctaggctgctagcccaacggcagcaacactcctttggtctgcatggggtggcgtgcgtgggcacggaggcccacctctccctctgttccctggagttctatcgtgccaatgacaccgccaggtgccctggggggggccctgcagtggtgagctgtgtgccaggccctgtctacgcggcatccagtggccagaagaagcaacaacagtcgaagcctcagggggaggtgtgtgagacagtgattatgacctttcccaccccaggtggagaacccctagcctggcaaccccagactaagcacagccctgacctttgaggacagagaggagccttccagggggtgggccacagacctgataccacccactcccttccaccaaagtctcactcatctcccaggtctgcttagccctccgtgcagatgttgccatttgcctctgttgggcacttctctcttctataggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggtgaggtggcatggaggtgggagggagagggaaggaggtacatgctcctggggggcatattccttcggaaggttaggtgtcccctgggcagacaatatatgcttaattacaacttcctgatctttgccatctggccctaggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccagggtcagtcatcctctctaccttggttgaggtctctttcatcctatccaggtctggtctccaatctacagtccaatggcccccagcccattgccccaggcccctgccctcctgcagctcccacctgacccatcacttgctagcccattatgtgcctgagtcacgcttcagccacatctgttagagactcccactacctcaccccaaagctttctccagcgcttccattctgtgtcactacagatccgactcagtgggggccgcagccaacatgaggggcgagtcgaggtgcaaatagggggacctgggccccttcgctggggcctcatctgtggggatgactgggggaccctggaggccatggtggcctgtaggcaactgggtctgggctacgccaaccacggcctgcaggtgagtgggaaggaaaggggagccgaggctgttgtctcaaagcctgtgttttgggcagagggctgaggaatgagtcccttggcccaagatgctggatcctgggccttacagaaacatctgcatatgtccccaggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagagtgagtgaaggagggggtgatgcatgccagggaagggagtgtctgggccacccgtttgcagggaaagggggctgtaatctggaggggcacttcttccccataaaagagccagtttcgccgggtgcagtggctcacgcctgtaatcccagcactttaggaggccaaggcggatggatcacgaggtcaggaattcaagaccagcctgaccaagatggtgaaaccctgtctctactaaaactacaaaaattagccaggcgcagtggcaggcgcctataatcccagctactcgggaggctgaggcaggagaatcacttgaacccaggtggcagaggttgcagtgagccaagatcacgccgctgcattccagcctcggcaacagagtgagactccatctcaaacaaacaaacaaacaaaaacaaaaacaaaaaactagtcttacacactagggagggatggaagcacccctctctgtgaagtcagcagtgacttctaacacccccttcctttcttggtgcagctgcatcagatctgttgctgcactcagcactggtgcaggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgccatgggtgagagggtagggagtcaagtagaagggcaagaccacgggggatggggcaaaccttctgggggcagagaaggaaacagaagttcccttctccccacaggcattaccacagcatggacatcttcactcactatgatatcctcaccccaaatggcaccaaggtggctgagggccacaaagctagtttctgtctcgaagacactgagtgtcaggagggtgagttggggactgaagtgaaccacatggtatccattgcacagcctttccttacactgacatatgccaatccctccagatgtctccaagcggtatgagtgtgccaactttggagagcaaggcatcactgtgggttgctgggatctctaccggcatgacattgactgtcagtggattgacatcacggatgtgaagccaggaaactacattctccaggtacctggagtctggggcttccagatgggtgagtggggggagcgttaaagacacctttgaattcgaggattgtcgctgggttaagtggcctttttctcactcacaggttgtcatcaacccaaactttgaagtagcagagagtgactttaccaacaatgcaatgaaatgtaactgcaaatatgatggacatagaatctgggtgcacaactgccacattggtatttgatgggaagagcaacccaggaagattaggggatgggagggaaagacgttcattctcttttccatagcttgtttctccatcttcccaccttcctgtagagctctcagtccctccacttctacccacccttctccacagtgcatctatctccctccctctgtgcagggcgcctcccaaattgcctgtccactctgcaggtgatgccttcagtgaagaggccaacaggaggtttgaacgctaccctggccagaccagcaaccagattatctaagtgccactgccctctgcaaaccaccactggcccctaatggcaggggtctgaggctgccattacctcaggagcttaccaagaaacccatgtcagcaaccgcactcatcagaccatgcactatggatgtggaactgtcaagcagaagttttcaccctccttcagaggccagctgtcagtatctgtagccaagcatgggaatctttgctcccaggcccagcaccgagcagaacagaccagagcccaccacaccacaaagagcagcacctgactaactgcccacaaaagatggcagcagctcattttctttaataggaggtcaggatggtcagctccagtatctcccctaagtttagggggatacagctttacctctagccttttggtgggggaaaagatccagccctcccacctcattttttactataatatgttgctaggtataattttattttatataaaaagtgtttctgtgattcttcagagcccaggagtcagtgctggtggttggagggacctgcccccactggttcatttaaccctctgtctcggtgccctcagaacctcagccagaaaggcaaggaggaaatcagagcaggagcctcatactcttggtgatctattcattctgtgacctcaggggtcacatataaggtcagtgtttctcgtccccgccggatctgcactgccaactgggattgggttcgaacagcttcataaacatcttcagcattttgtaccatctgctccccaatggccaaaatcacatcaccaggccgcagaccagccctatagagaaaaatggacagagagaaaggaaggagtacaaagcctagttcaaggacacatgcacaccttgcccatccccatatcacactgcagcctctccctcaccggtgtgcaggggagcccaggatgactttatggatgagtacaccatgctgaacatcgggaaagcttggttctcgaagctgtagttcagcaaggatgctgaaagtacacagatcaccctattagccaaacccaggcattctccccatcctgagttccacctcaagtctctcatcaacacattgataaatatatggacaggacatgggctaggtactacaaaatacaatggcaactcactttctgtcttctagcaataaagtgcaacatgtacataaaagatgtacaccacatgagggcaccaaatgacaaacagtgttaaatcaatagcactaatgtcattctagaatactaagagaagctttaaggggaaagaacttaagttgagcctaaaaggatggatctgatattaaccatataaaacaagaacagcataaataaaaaacatgggagtaggaaatcaggttggctgagtattcatataggaaggtattacagccaggtctagaaagttgatttacagacagatggaaaatggcccttaaatgccaagttaatggattgaaggcttgaaatcaaagcagtaacaggatgaaatcaatctggtgacaggtgtacaaagtggagtgggataagaaagtcaagatgatgaagggagacagctcttgtgattatttcaagtgtgacacagttcatcttagataaagacagaaatgagaacaaagctcaatagaggtgcccccctctgattacactggtcacattacatgtcactgtccctaaagctcatacctgggactcagggtcagcatcatcaccccaatgtagcgccgctgggacccactgattccggaggaggaatctgtgacagagggacaaatgagccccacccagctacatccttccttccctgccctcttctcccagtagaccaccctccaggaagtcccactgaatgcccttcccctatttccaccacattaaaggaacccgtttccccataaggcaggctcactcttcttttccccacgatgcagaaactctcgaagacgatcagaagggatggcaaaggagattccagctgtgaccttcatggtgttcactccaatcacctccccatcctgcagggatacagcccccagttccctagcctaaacaaatagtaggggatgggggcacccgaacaaaagtaccagcaagtgttggggagatctggttggatattgagagatagccaacaaagaactgctcagaaacttgaccaaacatccttgaattaggggaaacctacccttcccacactgacctggggcagggattcttggaaggaaggatgtctcactcaccaggttaaccaggggacctccagagtttccaaactgtaggacaaggagaaaacatgaaagagatctggggattctaagtctgggggcataccaggatgtaggtactttctccaaattctcttctttctcagcccatgaataagtggccacatttttgcagcctaagctctatataggctcatccaccatatatcagttggtgcttgtaccacacagcctctcccccctcccccatcatttgtcatttctctcctatcaggacgcacatcaatagctgcatcagtttgaatgtattccacattggtttgggggagtcccaggtctctggctggacgctgagcagagctaacaatgccggatgtgatcgtgttctgcagtgcaaagggacttcccatggcaacaacaaactccccttgccggacatcagctgagcgtcccagaggcagcgtggggagaggctcctaagggagaatgggtaaaagagacctgtcatctgaagatgcgagcaaataagcagctccaaccagacctggcctaccccagcccccaccttagtctgaatcctcagcgttgcgatgtctgccacgggatccacagctgtgaccacggcctcatacgtgtcgccgcttagcagtctcacacggactctgcgccgatcagccaccacatgggcgttggtgacaatgagcccatcggcagccaccacgaatcctgagccgttcgagatagggacctcgcggcccaagaaagggtgcctgaaatggagggaaagcacagataagaggaggctctgacccctcctacccgcccgccctccagcctgtggcttcagtgcctcccggtctacccccaccattaccggtccaggatctcgatatagaccacggcaggtgctgtcttctccaccacatctgcgatgaagttgtactgactccggggagaagcgggcggcgggctagggacggcggcgaggacggccggaggaccccgacccccgccccacaacaacaacagcactgcccccccagcgcccagcgccaccgccagccacgcgcgcgaacgggttccagagttctctgaggcctcccgggtcctggtatctggggtcaccgcagtcagttgtgcccggggacccggggtcccagacgtcaggcatgctcggggttcagtgaccccaacagacaaccgggcccagagactgggggtcccataagtcactcgggcccgggggtcagaagttcctgacgtcagcagggcccggaggtcaggggtcaaacggggtctcctcccccagcgaatgccccccaaagcccgccatgcccgaaggctccagcctgcaccccgccccgccctcggcgcagccatcagctccgccttggctgcctcctcgcccgccctactcagaggcggcacccaggacgcgagcaggcggacagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggtaagagacccggcgggaagagaccgatccccgcgtgctctcggccttcggcgcctgaccacttcgcctctcgcccccaggcttccgggtgactgcttcctactgctcgtgctgctgctctacgcgccagtcgggttctgcctcctcgtcctgcgcctgtttctcgggatccacgtcttcctggtcagctgcgcgctgccagacagcgtccttcgcaggttccgacgcgggcgttcggggagtgtcagagctgggtctggcccgaggccacacagtcaccacctcctgtgtccccagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcaccgtgagtgagagcgaggccgagagcgccacggggcggttccctggggcccagctgaaggcccccctgtccccactcgcgttccccatggaggatactgagccttacccctaaccccgatcctctacccaacatgtcagttttttttttcattttcctcaatatttttcttcttgctttctcttctcctggttcccagcctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcaggtgggtttagcacaggtatggggcgccagctgggtaggtggtcaagcttgtgggcccttgagtttttacaactttcttcggcccttagaccccatcatctccagttcatttcctttctgtccactttaagttctttctcctgaatcccttcattcttcaattatgtgcttgtagagtttgacagttgcctgttataaggcaggtgtgagctgctgactaggctggctggattcccatcctactttctccttcctcttctagttcctggccattttctatccaagatgtggtacaacctcttaccctgcaagttcagagacccctggtctctgtggtgagtgtgtgttgaacagggaatctctggggcttgaaggggaaatttcccatccctggccctggcttaggcctcatctcatgccctcccctcagacggtgtcagatgcctcctgggtctcagaactgctgtggtcacttttcgtccctttcacggtgtatcaagtaaggtattaactgtcctcacattttggtcgctggggagaggctcacctcaaggtcaaggaattagtggcctctgccctgtccatttgtagatctttatatcaaggttctaccacagaggcaacacaaagtatttacagtatttactattttcccacccaccatgcaaagaggtaccaaagtggggaatggtgacagcctctaccctgggtgcccacaacatagccctggattgtttctttgcaggtggcttcgtcctgttcatcgccaactaggggaagcgaatgaggagtttgcactccgtgtacaacaggtggtcgggtgcacagacagggtggaggcggggtccctgcttaggaggagagggaggaaagcttgagatcttgacacttccagtcttccaattctccctagctggtggccaaggaattgggccagacagggacacggctcactccagctgacaaagcagagcacatgaagcgacaaagacaccccagattgcgcccccagtcaggtatgtggtctctatacattacagcttttggggtttttttttttcggcctactgtgattcctcccctatttctgtgctagttagcctctccttctagttctctacttaccagaatttcttttttctttttttcctttttccacagcccagtcttctttccctccctcccctggtccttctcctgatgtgcaactggcaactctggctcagagagtcaaggaagttttgccccatgtgccattgggtgtcatccagagagacctgggtatgggaaagggtggccccacactgggagatgggcacagggaggaaaagtgggttgtgaaggaagaaagtaagtagggagtggactcccttctcttttctccccagccaagactggctgtgtagacttgactatcactaatctgcttgagggggccgtagctttcatgcctgaagacatcaccaagggaactcagtccctacccacagcctctgcctccaaggtgagacccaggaaatggtcagatccaagtgttggggtgagttgggggcaggctatgtactcccttatccctgacctttcttttttgatcctgagaccctagcatagtgcctctcttgcaaagtaggcattcgatgcgtgtttaatgatgatgactccgcaagccctctgacattgtgatcacctcagtttcccagctctggcccggtgacccctcagccaacagccctaacatttgccaagtcttcctgggcccggcaggagagcctgcaggagcgcaagcaagcactatatgaatacgcaagaaggtgagggggttagaggacaattaataggatgtggcaaattggagaatggaattatggagctactacggcaaagcctgaataatatctctccctatgtcccacaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaaggca

SEQ ID NO: 12805 - DNA, 7764 bp, Homo sapiens
tcttcactcactatgatatcctcaccccaaatggcaccaaggtggctgagggccacaaagctagtttctgtctcgaagacactgagtgtcaggagggtgagttggggactgaagtgaaccacatggtatccattgcacagcctttccttacactgacatatgccaatccctccagatgtctccaagcggtatgagtgtgccaactttggagagcaaggcatcactgtgggttgctgggatctctaccggcatgacattgactgtcagtggattgacatcacggatgtgaagccaggaaactacattctccaggtacctggagtctggggcttccagatgggtgagtggggggagcgttaaagacacctttgaattcgaggattgtcgctgggttaagtggcctttttctcactcacaggttgtcatcaacccaaactttgaagtagcagagagtgactttaccaacaatgcaatgaaatgtaactgcaaatatgatggacatagaatctgggtgcacaactgccacattggtatttgatgggaagagcaacccaggaagattaggggatgggagggaaagacgttcattctcttttccatagcttgtttctccatcttcccaccttcctgtagagctctcagtccctccacttctacccacccttctccacagtgcatctatctccctccctctgtgcagggcgcctcccaaattgcctgtccactctgcaggtgatgccttcagtgaagaggccaacaggaggtttgaacgctaccctggccagaccagcaaccagattatctaagtgccactgccctctgcaaaccaccactggcccctaatggcaggggtctgaggctgccattacctcaggagcttaccaagaaacccatgtcagcaaccgcactcatcagaccatgcactatggatgtggaactgtcaagcagaagttttcaccctccttcagaggccagctgtcagtatctgtagccaagcatgggaatctttgctcccaggcccagcaccgagcagaacagaccagagcccaccacaccacaaagagcagcacctgactaactgcccacaaaagatggcagcagctcattttctttaataggaggtcaggatggtcagctccagtatctcccctaagtttagggggatacagctttacctctagccttttggtgggggaaaagatccagccctcccacctcattttttactataatatgttgctaggtataattttattttatataaaaagtgtttctgtgattcttcagagcccaggagtcagtgctggtggttggagggacctgcccccactggttcatttaaccctctgtctcggtgccctcagaacctcagccagaaaggcaaggaggaaatcagagcaggagcctcatactcttggtgatctattcattctgtgacctcaggggtcacatataaggtcagtgtttctcgtccccgccggatctgcactgccaactgggattgggttcgaacagcttcataaacatcttcagcattttgtaccatctgctccccaatggccaaaatcacatcaccaggccgcagaccagccctatagagaaaaatggacagagagaaaggaaggagtacaaagcctagttcaaggacacatgcacaccttgcccatccccatatcacactgcagcctctccctcaccggtgtgcaggggagcccaggatgactttatggatgagtacaccatgctgaacatcgggaaagcttggttctcgaagctgtagttcagcaaggatgctgaaagtacacagatcaccctattagccaaacccaggcattctccccatcctgagttccacctcaagtctctcatcaacacattgataaatatatggacaggacatgggctaggtactacaaaatacaatggcaactcactttctgtcttctagcaataaagtgcaacatgtacataaaagatgtacaccacatgagggcaccaaatgacaaacagtgttaaatcaatagcactaatgtcattctagaatactaagagaagctttaaggggaaagaacttaagttgagcctaaaaggatggatctgatattaaccatataaaacaagaacagcataaataaaaaacatgggagtaggaaatcaggttggctgagtattcatataggaaggtattacagccaggtctagaaagttgatttacagacagatggaaaatggcccttaaatgccaagttaatggattgaaggcttgaaatcaaagcagtaacaggatgaaatcaatctggtgacaggtgtacaaagtggagtgggataagaaagtcaagatgatgaagggagacagctcttgtgattatttcaagtgtgacacagttcatcttagataaagacagaaatgagaacaaagctcaatagaggtgcccccctctgattacactggtcacattacatgtcactgtccctaaagctcatacctgggactcagggtcagcatcatcaccccaatgtagcgccgctgggacccactgattccggaggaggaatctgtgacagagggacaaatgagccccacccagctacatccttccttccctgccctcttctcccagtagaccaccctccaggaagtcccactgaatgcccttcccctatttccaccacattaaaggaacccgtttccccataaggcaggctcactcttcttttccccacgatgcagaaactctcgaagacgatcagaagggatggcaaaggagattccagctgtgaccttcatggtgttcactccaatcacctccccatcctgcagggatacagcccccagttccctagcctaaacaaatagtaggggatgggggcacccgaacaaaagtaccagcaagtgttggggagatctggttggatattgagagatagccaacaaagaactgctcagaaacttgaccaaacatccttgaattaggggaaacctacccttcccacactgacctggggcagggattcttggaaggaaggatgtctcactcaccaggttaaccaggggacctccagagtttccaaactgtaggacaaggagaaaacatgaaagagatctggggattctaagtctgggggcataccaggatgtaggtactttctccaaattctcttctttctcagcccatgaataagtggccacatttttgcagcctaagctctatataggctcatccaccatatatcagttggtgcttgtaccacacagcctctcccccctcccccatcatttgtcatttctctcctatcaggacgcacatcaatagctgcatcagtttgaatgtattccacattggtttgggggagtcccaggtctctggctggacgctgagcagagctaacaatgccggatgtgatcgtgttctgcagtgcaaagggacttcccatggcaacaacaaactccccttgccggacatcagctgagcgtcccagaggcagcgtggggagaggctcctaagggagaatgggtaaaagagacctgtcatctgaagatgcgagcaaataagcagctccaaccagacctggcctaccccagcccccaccttagtctgaatcctcagcgttgcgatgtctgccacgggatccacagctgtgaccacggcctcatacgtgtcgccgcttagcagtctcacacggactctgcgccgatcagccaccacatgggcgttggtgacaatgagcccatcggcagccaccacgaatcctgagccgttcgagatagggacctcgcggcccaagaaagggtgcctgaaatggagggaaagcacagataagaggaggctctgacccctcctacccgcccgccctccagcctgtggcttcagtgcctcccggtctacccccaccattaccggtccaggatctcgatatagaccacggcaggtgctgtcttctccaccacatctgcgatgaagttgtactgactccggggagaagcgggcggcgggctagggacggcggcgaggacggccggaggaccccgacccccgccccacaacaacaacagcactgcccccccagcgcccagcgccaccgccagccacgcgcgcgaacgggttccagagttctctgaggcctcccgggtcctggtatctggggtcaccgcagtcagttgtgcccggggacccggggtcccagacgtcaggcatgctcggggttcagtgaccccaacagacaaccgggcccagagactgggggtcccataagtcactcgggcccgggggtcagaagttcctgacgtcagcagggcccggaggtcaggggtcaaacggggtctcctcccccagcgaatgccccccaaagcccgccatgcccgaaggctccagcctgcaccccgccccgccctcggcgcagccatcagctccgccttggctgcctcctcgcccgccctactcagaggcggcacccaggacgcgagcaggcggacagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggtaagagacccggcgggaagagaccgatccccgcgtgctctcggccttcggcgcctgaccacttcgcctctcgcccccaggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcaggttccgacgcgggcgttcggggagtgtcagagctgggtctggcccgaggccacacagtcaccacctcctgtgtccccagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcaccgtgagtgagagcgaggccgagagcgccacggggcggttccctggggcccagctgaaggcccccctgtccccactcgcgttccccatggaggatactgagccttacccctaaccccgatcctctacccaacatgtcagttttttttttcattttcctcaatatttttcttcttgctttctcttctcctggttcccagcctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcaggtgggtttagcacaggtatggggcgccagctgggtaggtggtcaagcttgtgggcccttgagtttttacaactttcttcggcccttagaccccatcatctccagttcatttcctttctgtccactttaagttctttctcctgaatcccttcattcttcaattatgtgcttgtagagtttgacagttgcctgttataaggcaggtgtgagctgctgactaggctggctggattcccatcctactttctccttcctcttctagttcctggccattttctatccaagatgtggtacaacctcttaccctgcaagttcagagacccctggtctctgtggtgagtgtgtgttgaacagggaatctctggggcttgaaggggaaatttcccatccctggccctggcttaggcctcatctcatgccctcccctcagacggtgtcagatgcctcctgggtctcagaactgctgtggtcacttttcgtccctttcacggtgtatcaagtaaggtattaactgtcctcacattttggtcgctggggagaggctcacctcaaggtcaaggaattagtggcctctgccctgtccatttgtagatctttatatcaaggttctaccacagaggcaacacaaagtatttacagtatttactattttcccacccaccatgcaaagaggtaccaaagtggggaatggtgacagcctctaccctgggtgcccacaacatagccctggattgtttctttgcaggtggcttcgtcctgttcatcgccaactaggggaagcgaatgaggagtttgcactccgtgtacaacaggtggtcgggtgcacagacagggtggaggcggggtccctgcttaggaggagagggaggaaagcttgagatcttgacacttccagtcttccaattctccctagctggtggccaaggaattgggccagacagggacacggctcactccagctgacaaagcagagcacatgaagcgacaaagacaccccagattgcgcccccagtcaggtatgtggtctctatacattacagcttttggggtttttttttttcggcctactgtgattcctcccctatttctgtgctagttagcctctccttctagttctctacttaccagaatttcttttttctttttttcctttttccacagcccagtcttctttccctccctcccctggtccttctcctgatgtgcaactggcaactctggctcagagagtcaaggaagttttgccccatgtgccattgggtgtcatccagagagacctgggtatgggaaagggtggccccacactgggagatgggcacagggaggaaaagtgggttgtgaaggaagaaagtaagtagggagtggactcccttctcttttctccccagccaagactggctgtgtagacttgactatcactaatctgcttgagggggccgtagctttcatgcctgaagacatcaccaagggaactcagtccctacccacagcctctgcctccaaggtgagacccaggaaatggtcagatccaagtgttggggtgagttgggggcaggctatgtactcccttatccctgacctttcttttttgatcctgagaccctagcatagtgcctctcttgcaaagtaggcattcgatgcgtgtttaatgatgatgactccgcaagccctctgacattgtgatcacctcagtttcccagctctggcccggtgacccctcagccaacagccctaacatttgccaagtcttcctgggcccggcaggagagcctgcaggagcgcaagcaagcactatatgaatacgcaagaaggtgagggggttagaggacaattaataggatgtggcaaattggagaatggaattatggagctactacggcaaagcctgaataatatctctccctatgtcccacaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaaggca

SEQ ID NO: 12806 - DNA, 1118 bp, Homo sapiens
cagggttggtggtgactacgtgggtctggagctgactgccgtcctgacacgtcctagagctgcaagcaggtttgaatccaggatccctgtgactctgctgttcctctccccaccccctatattctttatccttttcccttcaggactttcccacaggttactaggtctcacataatttctactgcccttgaggacccctgcctaagtaagatttctactacctgccaacggggtaatagtctcaggtagatttctactacctgactatagggactgtcgactaactctcagtagccctttatcaaaatacctagcactgtttcctggcaggaaatgctgggaagggtgggccccagagcatgatcaactgaaggtagaggttaaggatcagggctgaggtgggaagatggtgtcggtcaccaaatatgaccttactggctgctctgccttctgcaggtcctgccagagagccaccatgacctctcagcctctcaggctagcagaagagtatggcccaagtcctggggagtctgaactggctgtgaacccctttgatgggcttcccttctcttcccgctactatgagctgctgaagcagcgccaagccttgcccatctgggctgctcgctttaccttcttggagcagttggagagtaaccccactggagtggtgctggtgtctggggagcctggttctggcaagagcacccaggtgtggtgggggttgtgggggcaggcagattctgggagtggacaaagggaggacaaagggaggacaaagggaaagtggcctttccctgggcaaggggggactgggctgcgtggggtcatgaggaaggtgaacgaagagagatgggatgggttaggttggccctggaggctggtgaaagaccaggggactccccaaataaggaaagattaaagtggccatagttccctgagcacttctgactgaagtcctacatcttcctcactggctctccttccctacttctatcccagatccctcagtggtgtgcagagtttgcgctggccagagggttccagaaaggacaggttactgttactcagccctaccctcttgcagcccggagcctggctctgcgggttgctgatga

SEQ ID NO: 12807 - DNA, 380 bp, Homo sapiens
cccttcccactacaccaccaggcttcagcctccaaagagacaagtgcttggtacctacatgcaaagtgtgtgtgctggggggtgggagggctgcccagaacaggggagaggatggtgtaaaaaaagacctactcctttcctgttaccctctccccacatgtaccaaccttcctgttgctccctccatccacagaataatagctaccatttataaaatgtttactctgggctgggagcagtggctcacacctgtaatcccaacactttgagaggctgaggtgggatgatcacttgaggccaggagttcgagaccagcctgagcaacactgtgagacccccccgccatctctacataaataataaaaacttttaaaaaaaca

SEQ ID NO: 12808 - DNA, 176 bp, Homo sapiens
aggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctggg

SEQ ID NO: 12809 - DNA, 1118 bp, Homo sapiens; identical to SEQ ID NO: 12806

SEQ ID NO: 12810 - DNA, 38771 bp, Homo sapiens; identical to SEQ ID NO: 12795
  misc_feature (29356)..(30880): n equals a,t,g, or c

SEQ ID NO: 12811 - DNA, 121 bp, Homo sapiens
cccggctaattttgtatatttttagtagagacggggtttcaccatgttggccaggctggtctcaaactcctgacctcaggtgatccacccatctcggcctcccaaagtgctgggattacag

SEQ ID NO: 12812 - DNA, 144 bp, Homo sapiens
caggcacataccaccacgcctggctaatttttgtatttttagtagagacagggtttcaccatgttggccaggctgatcttgaactcctgacctcaggtgatccacccgcctaggcctcccaaagtgctgggattacaggcgtga

SEQ ID NO: 12813 - DNA, 125 bp, Homo sapiens
acctcgcccggctaatttttgtatttttggtagagatggggtttcaccatgttggccaggctggtctcgaactcctgacctcaggtgatctgcctgcctcggcctcccaaagtgctgggattacc

SEQ ID NO: 12814 - DNA, 141 bp, Homo sapiens
ggattacaggcacctgccaccgtgctcagctaatttttgtatttttagtagagatggggtttcaccatgttggccaggctggtctcaaactcctgacctcaggtgatccacccgtctcagcctcccaaagtgctgggatta

SEQ ID NO: 12815 - DNA, 130 bp, Homo sapiens
tttttgtatttttagtagagacgaggtttcaccatgttggccaggctggtctcaaactcctgacctcaggtgatccacccacctcagcctcccaaagtgctgagattacaggtgtgagccatcgtgccca

SEQ ID NO: 12816 - DNA, 146 bp, Homo sapiens
gcctcgctaatttttgtatttttagtagagatggggtttcaccatgttggccagactggtctcgaactcctgacctcgggtgatccgcccgcctcggcctcccaaagtgctgggattacaggcgtgagccaccatgcccggcctgg

SEQ ID NO: 12817 - DNA, 161 bp, Homo sapiens
gctggggttacaggcacgcgccaccacgcccggctaattttttgtatttttagtagagatggggtttcaccatgttggccaggctggtctcaaactcctgacctcaggggatccacccgcctaggcctcccaaagtggtgggattacaggcatgagccact

SEQ ID NO: 12818 - DNA, 170 bp, Homo sapiens
ggattacaggcacccgccaccatgcccgactaatttttgtatttttagtagagacagggtttcaccatgttggccaggctggtctcgaactcctgacctcaggtgatccgcccgcctcagcctcccaaagtgctgggattacaggcgtgagccaccgtgcctggccagaa

SEQ ID NO: 12819 - DNA, 124 bp, Homo sapiens
ttttttttgtatttttagtagagacggggtttcaccatattggccaggctggtctcgaactcctgacctcaggtgatctgcccgccttggcctcccaaagtgctgggattacaggcttgagcca

SEQ ID NO: 12820 - DNA, 122 bp, Homo sapiens
ttttttttttgtttttagtagagatggggtttcaccatgttggccaggctggtctagaactcctgacctcaggtgatccacccgcctcagcctcccaaagtgctgggattacaggtgtgagc

SEQ ID NO: 12821 - DNA, 125 bp, Homo sapiens
gtatttttagtagagacggggtttcatcatgttggccaagctggtctcgaactcctgacctcaagtgatccacccgcctcagcctcccaaagtgctgggattacaggcgagagccaccgcacccg

SEQ ID NO: 12822 - DNA, 95 bp, Homo sapiens
ccccatgcctagctaatttttgtatttttagtagagatggggtttcaccatattggccaggctggtctcgaactcctgacctcaggtgatccacc

SEQ ID NO: 12823 - DNA, 121 bp, Homo sapiens
gtagagacagggtttcaccatgttagccaggctggtctcgaactcctgacctcaggtgatccacccacctcagccttccacagtgctgggattacaggcgtgagccactgtgcccggccta

SEQ ID NO: 12824 - DNA, 127 bp, Homo sapiens
aatttttgcatttttagtagagacggggtttcaccatattggccaggctggtctcaaactcctgacctcaggtgatccgcccacctcggcctcccaaaatgctgggattacaggcatgagccaccac

SEQ ID NO: 12825 - DNA, 122 bp, Homo sapiens
tttttgtatttttggtagagacgggggtttcaccatgttggccaggctggtctcgaactcctgacctcaggtgatctgcccacctctgcctcccaaagtgctgcgattacaggcatgagcca

SEQ ID NO: 12826 - DNA, 5775 bp, Homo sapiens; identical to SEQ ID NO: 12799

SEQ ID NO: 12827 - DNA, 738 bp, Homo sapiens; identical to SEQ ID NO: 12800

SEQ ID NO: 12828 - DNA, 131 bp, Homo sapiens
ttttttttttgagacggagtctcactctgtcgcccaggctggagtgcagtggcgcaatctcggctcactgcaagctccgcctcctgggttcatgccattctcctgcctcagcctcccgagtagctggaact

SEQ ID NO: 12829 - DNA, 8261 bp, Homo sapiens
ggaaacagcccccgcgcagtcggtgtcgctgtgaacggaaaagggccttccttacacaggaaacggggtctctgggggatccagtgacgtgcccaaccacagagaccaggtgagactggctgatggtgtctggggctgcaggtgacttagttgggggacctgctcttggcctccagactgggcctgatgcgtgggcgctgcctgtgtgcagcgcaagggctcagctgcctctgtctgttcccagacccctcctcctgtagagagtggtgctgccctctcgggatgtacctgcaggtggagacccgcaccagctcccgcctccatctgaagagggctccaggcatccggtcctggtccctgctggttggtaaggctctccacgtccctccccagaaccccagaaccggaagcctgactttcaaaaaggatgaaaatgaaacaaaatattttctcttttttctattaccttgaaatctaatggctattttgtttctttgtatccattcaaattctatctggtgtacttggttttacagataatgcatgtctgttttgtccccttttaatcactaacacccagcgtatttaatatactctatgagcttttctgaggtcaccatattttcctttgtacttgttttgaccacgtgatgggtgatcgtgggttcccatgtctcctcctccctggtcctcagacctcttcgtaggactcacagtcactaaccacgtgatgggtgatcgtgggttcccatgtctcctcctccctggtcctcagactcttcgtaggactcacagtccactaaccacgtgatgggtgatcgtgggttcccatgtctcctcctccctggtcctcagactcttcgtaggactcacagtccactaaccacgtgatgggtgatcgtgggttcccatgtctcctcctccctggtcctcagactcttcgtaggactcacagtccacttagcctcccgtcctccatcgctacccaccagtagggtcctgtaccttgggacagctgcacttgtgttgacgggacaccgtgtgaggagtggtgctggctgtacctcagcagctggggcccaccttttttgtgacacgccacagcctcctgtgtgttttgcatgacacgctgtgttgtaatttctttgtgcacagtcttcaggcctcaccacgtgctactggagtaacacccgtgtcagttatggagcctcacacagcagatgtgtctagtaaatactgtgaatagcgtatactgtgttttgcttttgttttctttagtaatgaggtctcgttatgttgcccaggctggtctcaaactcctgagctcaagcgctcttccttcctcggcctcccaggtagctgggattacaagtgtgtgatactacgcccagctatactgcattattgaaccagcttcctggctgtttcccctactctgaacctggtggtctgtaacccctgaccacagctgttcctacagtgggaagggcctgctcatcaggggctgtggctcctggtcccgctgcaccagggaggtggggtcttaccgggatcaataggcaggcagtcactttctcttcataggaatcttgtcgattggcctggctgctgcctactacagcggaggtaaagcaccccccgccccacccccccatgactgtctcagctgtttggaaaacagagaaaagaaggaaaaactgtcatttgtgactgtccatggggcggcctttaggatcggcacctctgccccttgattgctggcgggcaccgccctccatgcgctgctgttcttccgcacgcccatcctgcccagcgctcagcccacatttcacttcttttttttttttttttgagacggatctcgctctgtcacccaggctggagtgcagtggcgggatctcggctcactgcaagctccgcctcccgggttcacgccattctcctgcctcagcctcccaagtagctgggactacaggcgcccgcatctacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccacatttcacttcttaagtcttctgtgtttttgggtcatcaaatattcccggagagatgctcttgaggatctaagatccagctgtgggatgaggtgtacttcccaccctgccacaatcactgggcctgcccatacgggcagaggccctgtgcgccccacctgcctctctcacgtggactctgggggtcagagctgggtggggtgtgcgcgtgtgggtcctgagtggccagggcagggtcagcagcacaggaagctgcccagggggtccttgcaagcgtgggctctggcagcgtctgggggaggctgtctaggcggggcctcccgtgggcatgtcctggagctcacaggctggcgccctatgcccatctccagatagcctgggctggaagctcttctacgtcacaggctgcctgtttgtggctgtgcagaacttggaggactgggaggtaaggccggctcgggtgcgggacagagtccagggctgttcagctcctgggttttttgcaatgggaatgaaaggaggaggaagggccctgggtgcctagcgcctccccgtcctgaagcgttggtccctgcttggaggtctccgttcatcaggacatggcccctgcactcatatgggaccgttcttggccaaggaattccccgaaggcatttttctcttagaagctctccatgactatcttcaccaaagtgctttcttcccagagttgccacaatgggatgcgagtcagctttccccgtggccggccctcccacctcggagcccctcatgagtcctttcagcctggcccagtgctgccctctgacctccatgccctcgtttgctggttccactgcctccctgcacttgttttgcctgcagggtggagcaagcgcctgctgcacctgcccacctctccatttcccaacaggagtcgggttggctgccgatatccggctctgacagagagcacctgtggcttcaggggtttgggttctgactgggagggtcccagccccccttcttgagtgtccaccctggtgagggtgggggtgaggcccagcggcacggggccccgttcctggaggttcatggtggtcagtgcatgtcggtttccaggaagccatcttcgacaagagcacagggaaggttgttttgaagacgttcagcctctacaagaagctgctgactcttttcagagctggccacgaccagggtgagtcgtggggagcgtggggacatgggacacggccacagaggcggcgcacttgggcgtctgggtgactcacggggcctagaggggggcctggaagtgcctttggtccaagctcacctgcttggtgaccagggttgtgtcctgcccgctggaagcaggatcccacggatacgccccacctgctcacctgctcagcagggtcctagagcctcctgggttctttagaggtttggcccctggggagagtgggaggagcaggggtctgaggagcaggggtctggcagagcaggggtctgaggagcaggggtctggcccacccgggctcgggcagcctctgtttagctgcattctcctgtctgcctggcagccacttgtccgcaggtgcagtctggccccagcggcaggtcacaggacggggcagggagagccatggcagcccgtgggcgttctggagtggggccacctggcttcttgcgggccttggcgctgctccagctttcctgtgggttctactgggcctgcagtaggggctggatggtccgaggaactccccacccttgagcctgggcactggcccagctgtggtcagtaccagtttcctgtagatgctgccgcacagacagagagaggccccggggtccggccgcccatgcatagccccagaggggacagattctggcgaccagagttgctgggcagtcttgggtttagtgccgcaatgctgcacttctgacaggctgcttcctggatccctgcagggacctggccagggcattggccccaggtcacctgtggctttggggagagcagttgcagggctggcctgggctgtgggaggcagctgtgccgttttctgacagccattgggaccgccccagtacccgaagaggtggctgccctgagttgccacgggaaactgcagggtggccctggctcagcagccaaccttggggagacctggaggaacagtgcagtgtaaagatggcctcgcgctgacgggtccccgcagtcggcactcccaggagaaccagcgggctgtgcatgtgacccgccagcctgcaccgcgggcacgtccttcccacccagaggaccctgcactgccttcagggccacagcagtcctccggggcccagcctcaggcaggaaacagcaaatgcttttgctgccaaccaagtgtggctgtcgctttcgatgatgccagtgcgctggtgcactgccgggcagcatgtgtgggcggggatggctcggccactgaccgtctccccgcagtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcaggtaaggctgtgggactttgatctggctggagctgcagccgtagcaggtcactcccgttcctgactgcccagagctatggggcagctgggagaggagatgagtttgtggacgggacacagaggggcccacgggaagcgtgtgcaggctcaggggcagccccactgtgacggggaggctgggagcaggccaggaagtgctgggtccagtttgggagctccagggtctgcgggaggtaggtggtcgaggaggagactgctgtggggtctcacggtgccctatgccgaggtgacctgaccttcctccgttgccgcctcgcccagtgatgtggaagcatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcagcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcgcaggcccaggaatggctgggtaggacagggaacacctttgccccacgtctggctgtgacctcggtgaaagccgacaggagagagatggaccctcctcctcagtagtggctgccagtccctcgttgcaggacagggtcatcataaccataaataacccttcacgtgtcacctgcagcttccactctttatttccaaagaatcagtgtcacacatgcagatcacaaagcgggtctccctgtgctgcttccttctgtgttttctagtctctcccccaggggctgcccagggccctcaggaactgagtgtgggcaagacactgctgggccagagggcacgacgccacgtgggcccgtattgcccaggccatttggcagtgcagagcccccccagcctccagcaggagccccctggcatgagctctcccctcaggggtcctgagcaacgtccctgccagggctggtgggtggcagcgggggggcagacacctcgctgaggtcctgcagcagagcttgcagccgctgcaggctggggtgcacgttttcctccagccactcctccacggcatccgggtagaaagccagctgcagggcacctccagctcctgcacgagggtgctccactgtgccaggaggctgcaggtgagggcgccatgaacgcacagtctgcacacttgggacttgccctcagccccatggtcagtactgccctgtgcctcagttcacctgtgaaatggggctactgaccctacctcatcggcatgtcgggaggaacaagtcggtgacagctgcacatctgagaccagagggccttttacaactaggggctcaccctctgctctctagttgagggacatgtcagcaacagcagcagttctcagggaacccatggctgcacggcctataagagcccagggcctcacctgagcgctgcgggctggatgtgctgaaccatgaccgggtggatgagcttccgctggcggtggtaggggctgaaccagccagtgacatacctggggcaaatccacataggggtgtgccgcggctaccaaggcagccgtggggcggctttgcagtaatacagaaaatgtttaagaatggggttgacatttctaagtcttatgtcccccagaaagtctttgtgaaggatgaggctgcctcctcctgtgcctgggagtggggggacttgtgaacctgcccctcaccagcacctgtccctacccccctcacccacacctgcctcccacccacacctgccccatgccttcccgcttacccacacctgcccctcagccgcacctgcccccatgcctgcctgctcacctgcacctgcccctcacccacacctgcacgctcacacctgcctgttcacctgcacctgcctcccacccacacctgcccctcacccgcacctgccccatgcctgcccgctcacctgcacctgcccctcacccgcacctgcctcccacccacacctgccccctcacctgcacccaccccatgcctgcccccctcacccacacctgcccctaacccacacgctcacctgttgccctccagcagcgcatccacagagctgcgcagatggaggctgacttgtgtgacaagggcaaggatgttgctgccagggaaggagccggccccctccctgcggagagccctgctgagaacagctgtctccacgggcgggggaaggggaggggaagaaggggacagggagggctgcagggtgcttgcctaacagggtccgttttttccaggctggaaatcccgagaaggttctccactttcgctttaacatcttcatcaaatcctcctgaaatcacaaatgagcggggcggttggaggggcctctggaggaggggagggggctacattgggacctgcaggc

SEQ ID NO: 12830 - DNA, 280 bp, Homo sapiens
tgcggaactcccgtgtggaagattagcccctttggtgactcgtcggttctggccgctttgggaccctctactgtgcagtctgaactttcagcaggtggaggagggcagagagagagctgagatcgttggtccatgccagtgcgagagccagtacggccggaagccatgatgggactttcagttcctttcttggtggaggccagcacaggggagagggggtgcccacagatgctagaagcttaaaggctgctgggggctagcggcctcaggacataaggtt

SEQ ID NO: 12831 - DNA, 802 bp, Homo sapiens
gcggcaatggagagccactggccaggcccagccccgcgtgtgccggccaaggggactggcggcaaatgggcctgctgcttctctttaaacacgtgaaatacgttccttattttaaaaatcagaaaacagaagtaagactgtgttgccagcagcaacacccggacagcaagtggctcttcctgctgggcacagcccgacccacacaggtgtccagggctcacgcagagtttgccactgtgttttacacaatcgatggaatattctagagcacccgaaacaaacccatgaggcctgcaggcaccagcgtggacgaatctccgacttggtgttcatggaaatgcttgctgcaagaggctgacggccagagggcaggagggaagtgccccagtcacgggtggcggatgggcgcgtgggcaagggacactgcaaataccgtcaatattaacacagctctttagtgtggggtacaggggtgtctgtttttatcgtttctgcccctttctaagcagttgagagtcagcaactgagaagtcaatctgatctcattctgcgtcctctcaccggccgcgtccccgtccctgggccgccgcgcctcgggatacctctccgcgcgtctcggccatttttctttctgcatcagcaccacgcagtcgctaatttcccgtgtggcctgcgagtttccacacacacagctcctctggccaagccccctgccgaccccaagggttccccggtgcctgcccctgcccatgggtcccgctgctccctcaggagacctggaagtgtgagtgctgggtccagg

SEQ ID NO: 12832 - DNA, 640 bp, Homo sapiens; identical to SEQ ID NO: 11932

SEQ ID NO: 12833 - DNA, 606 bp, Homo sapiens; identical to SEQ ID NO: 11933

SEQ ID NO: 12834 - DNA, 628 bp, Homo sapiens; identical to SEQ ID NO: 11934

SEQ ID NO: 12835 - DNA, 640 bp, Homo sapiens; identical to SEQ ID NO: 11932

SEQ ID NO: 12836 - DNA, 513 bp, Homo sapiens; identical to SEQ ID NO: 11936

SEQ ID NO: 12837 - DNA, 612 bp, Homo sapiens; identical to SEQ ID NO: 11937

SEQ ID NO: 12838 - DNA, 462 bp, Homo sapiens; identical to SEQ ID NO: 11938

SEQ ID NO: 12839 - DNA, 640 bp, Homo sapiens; identical to SEQ ID NO: 11932

SEQ ID NO: 12840 - DNA, 640 bp, Homo sapiens; identical to SEQ ID NO: 11932

SEQ ID NO: 12841 - DNA, 654 bp, Homo sapiens; identical to SEQ ID NO: 11941

SEQ ID NO: 12842 - DNA, 414 bp, Homo sapiens; identical to SEQ ID NO: 11942

SEQ ID NO: 12843 - DNA, 647 bp, Homo sapiens; identical to SEQ ID NO: 11943
  misc_feature (29)..(29): n equals a,t,g, or c

SEQ ID NO: 12844 - DNA, 640 bp, Homo sapiens; identical to SEQ ID NO: 11944

SEQ ID NO: 12845 - DNA, 640 bp, Homo sapiens; identical to SEQ ID NO: 11945

SEQ ID NO: 12846 - DNA, 571 bp, Homo sapiens; identical to SEQ ID NO: 11946

SEQ ID NO: 12847 - DNA, 640 bp, Homo sapiens; identical to SEQ ID NO: 11932

SEQ ID NO: 12848 - DNA, 639 bp, Homo sapiens; identical to SEQ ID NO: 11948
  misc_feature (88)..(88): n equals a,t,g, or c

SEQ ID NO: 12849 - DNA, 397 bp, Homo sapiens
atcaagttttttggggtcgaggtgccgtgaagcattaaatcggaaccctaaagggagcccccgatttagagcttgacggggaaagccggcgaacgtggcgagaaaggaagggaagaaagcgaaaggagcggacgttagggcgctggcaagtgtagcggtccgtgcgcgtaaccaccacacacgctgcgcttaatgcgccgctacagggcgcgtccattcgccattcgaggtgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 12850 - DNA, 648 bp, Homo sapiens; identical to SEQ ID NO: 11949

SEQ ID NO: 12851 - DNA, 434 bp, Homo sapiens; identical to SEQ ID NO: 11950

SEQ ID NO: 12852 - DNA, 624 bp, Homo sapiens; identical to SEQ ID NO: 11951

SEQ ID NO: 12853 - DNA, 509 bp, Homo sapiens; identical to SEQ ID NO: 11952

SEQ ID NO: 12854 - DNA, 654 bp, Homo sapiens; identical to SEQ ID NO: 11953

SEQ ID NO: 12855 - DNA, 546 bp, Homo sapiens; identical to SEQ ID NO: 11954
  misc_feature (20)..(20): n equals a,t,g, or c

SEQ ID NO: 12856 - DNA, 654 bp, Homo sapiens; identical to SEQ ID NO: 11941

SEQ ID NO: 12857 - DNA, 5852 bp, Homo sapiens
tgtgggtgttagacatcaactctacatttattgcagtcctttaagtctatgacggcggggcagccgctgacagcatgcagagcaagttaggaaaaaccgaggccctgtgggaacagcaacgcgggctccagccaggctctcgtcctcgcagcctcccacaagacctggggctcagggcagccgcttccccacccagcacagcagcagaggggccctagagcccccacagaaaggactgtcccagcctcgggagcaagagatggctccctccggacgggcctcatccaactccgccctggagtgtggctggaaggaagggacagagaaagaagggacagaggaaaggggctgtcccagcccaagaaggcagttccactgggaagtcagtcaggtccggcggcagcgcttcctctggcagggccgaggctcgcgactgctggggtgggcggaggtcgctgcctggggatcggacactggagccttgcggcggctgcaactcatgctcaggacccagcccagcttgttgtgtagcacctgcttgaggcccggcggcagcggcagaccctccagcgtgtctcccgagtctggccgcagctggcgcaggcggtggcagcacaggtactggagggaagtggcgctggcacaggagcgggtgaccttcatgctgctccgggccgccgtggagcacaccatcgggtagaatctcttgttctgcagcttggtggctgccacacctggaagggaggggcccagcctgaaccccaggcagggaaggggccagctactgggcgcagcccctcagacctcacgctacagtcacccgggtgggcagctggcacagctgaggcaaggcagggtgcacgcgctggccctgccactccagcctggcctcactgtcccaccccctgggaccctggggcctcaggcttctgggaggaaccctttcagaaaacctcagtgtcccctgggctggggcggggtggctgcctccctcggggtgacagctgagaggagctcaagtcctgtgacggcctcacctatacacttcctgttcttgaaaaaggtgagtgtgccgtgccaggtgtccaggtgcacgccaatgatggagccctggccgaaccgcgacgagaagctggtcttgtcgcccttgtggtggaggaggcctgggggcagccagggtcgcagtgagcccgggagctccaggctcggccccgccccaccctgggcctcacgcacccgtgtaggagaggccccagctgtcctcatccctgcccagcaggctgcagaacgtgtggcggtatttgtccaggtccacatccgacgtcccgatgcccaccatctaggaacaggggccaggcagagggcgcggggctgggctgccggagccaggttccccagaagcaccctgggccgaagcaacttaccatgtcggtgccgtagacgggagaggtcatcttgatctcccagaagtgctggccctcccccagctccttggtgccccggatggccgctgtgccgcagctgtactccatgtggaagctgaccttacggttgtcacagctcagcagggtggctgatgacttatttaagtcatcccagacccagtcgaaatctgcaagagaggcccaggctggggcagccctgagagctccatggggctctgccctgcccacccccaggcccgcccgcagtgcagtcccagcaggggctgggccccacgctcacactcgtcttcctctccgcagcggcagtccctgccccggtgggccgagtgcaggctgctacagaaggaggcctcgctctgcccagcacagtcacagaaggactcgccggtcacgggcaccgcactggggatggatggcggcagcgtggagtactcggggtcggagtccgagtcgctgtgctgggagagaagggccggctgttactacctgttgcccgctctctaccctctcacccttgccctctgtccctgtcccaccctgtccctgacccacccaggaaaggatgggggtccaggcctccagggacttcacagtaccccgagcgcacagcccaggctccctcccaacgggctccggctctgccccattctgcatgaccaggagggccctggaggcccagccacagagcagtagccaaggctgcctggcctccaagtggtttctagacggtggataagccccaggtccaccccacctgcccagagctgagatggtgtggacaccttccctgctaggccagccctgcaggggcccccaggcaaggccaccacccccacaccaggcccagctgcagccacccggcctcagggcagtccccaccacactgtggcccaacgaccttcctgttacctgagcagacctggctcaccacagggtcctactgcccagtgcccactacaggccccgcccctcctggtgcaggtttcagctgtcacctccctgaggcttctccagccccttcacccctgttccatttttcttcttttgcttcactgaagttctccttggtcctgattcttggcctcctcccaccagaacgtgagctccttgtgggaggcagtgcccctcccagcctcctccctgtcacagactgtgtgggggccacccaggggctgaatggaccagggggtcagcagggagagtgctaagtggtggcggggggcctgtggcagaggccttgtgacagtgagggttgagggctggtccagagagatgatgtgatccccaggagaagccacaggggaccatgacatgggcgccaccagcttccaggtgaacgtggacctatcgaaagccagcttcagggcaggacactgtcctttctggaggggatggccccaccccacagacaaggcaggcccagacaactctaccccactgcctagaagtgcgggtccccagagccagggtagaccccctgagtcaggagcccgggcacagaactgagcacctgcactgcaggcccagggccgggttccctggagaaggagaaagactgaagccactgcctacctcctgcccacaacagactgcaggcccatttggtgacacaggacaagcagcacatgtgtcgaacactgccgagcccgcaggcacgcctgcatcccacagccacgagcctgtgaggctcaggcatgtgacctgcaggagctggaggcgggcgggaaggcaggtgggggcctctccctggctggagcagggagctccaggagacctcaggacggcccccacccggtgggtaaggaccctgtttcccaatttgcccccaaggcctaatggacccaccgggcttagggagtcctcactcagaggagaggagcccacccctcccaggacacctggctgagccggaacagcagcgcaggggagctgtgacagcagagagcagcaccaggtcacacaagcagccgccccggaaggacacggcccatggtgacagaggacaagcagcatgcgtgtgtcagacactggcctggcctgtggacacgcccgcgtcccacagccatgaccctgcgaggccaggagagactgctccagggcacatgacctgtggtagctggaagtggggcagggaggcgcagccacactcctgctctggtccgagggagatctcaggaaaccgactgggaaatcaccccccacagggacccccacccctcccagcctcactgcgccccgtcaggccaggcagctgccctcagggtctgccaaggtgggggtcaagggccatgggggcaggtagctctgcctgcaaagcccacaagcatgtcagatcacctgggctgcagacagacaaacacctgagctgttctgaataccttcaggttcctggcctcgctgagcaagtgcagaaatttttaccttcaaggatcagggtttttctgtttgtttgttttttaacacacacatatgtgaacaaagagtatgcgtttgtactggcagaagaagcgtctggtaagacaaccagcaagttaacaatggtcacctccagaaatgggctgggtaaaccaaagaatttttttgtttttgttttttttgagtcagggtctagctctgtcacccaggctggaacgcactggtgtgatcacggctcactgcagccttgacctccctggctcaagcaatcctcccagctcagcctcctgagtcgttgggactacaggcacgtgccaccacgcctgacacattttttaaatttttgtagagacagtgtttcaccatgttgcccaggcaggtctcaaactcctgggctcaagtggtcctccagcttcagcctcccaaagtgctaggattataggtgtgagccacagtgcccagccccgtagtggagaatttctgttgaatgaaccaaaagcaactgccaacctctccatgcaccatgtgtttcagaggagaaagcacagtgaagaatgcagtgtgttctgaggtcctgtcacccctgaggctgtgtgtgtcctttgccaaattaaagagtcttactgaatgcggtgcatccaggagacaggcccaggtttggactggtcctctagcctcagaagcatctttttctccgactgattccgtgttcaggtaatgtctgcctgcctgcctagggcatctccacaccttaggccagccacgtccgcctcgcccgctggaacctacctgcccatcagagtcgtagccccagttagtggagcctgctagagccacggcccgggcatctgcgtctcggcgggctgcactcaggacgaagtgccaggccctgctgttccgggggcgtctggccatggtggaaagaatctagaagaaaacacaggctctgggcaaaggaagactcacagcactcccagccctgagcttccaggctgggccacggacccactcaaagtggggactgcaggggccgcaccggtgcccagccagggctccagaacgcttcaggagcccgtacctcaccccaggatctgagcagctcaataaaacccaggtagatcctgtgaaacgccacccagacacccatgactccggaatgcgaatcccagcccctctctccggttccacctcacgaacctggctgccccgcccgcctgtcccgcaggcatctaaaacctccactcgctcctcctctgtcgtccggtttgacaaatggcatctccggcctcccagttcctcatgccagaagcaccgtgaccgctccccgacaccttcccctcacccccggcccgaccgccgcacccgcctgcatcctcctcccgccaccgtctcctgggccgcgcagctcgccttcccctccgctcgctaccgccagggctcctcgtgaaacacaaatcttaaaacctgctcagcgctggccgctgttatggtataaaatgcaaaaggctgcgagggccaggtctgcgcttcccaggccacctgcctggcacctccctcgccagctccggggttcccgcctagccttccagggccgacccctgcgccgggctcgcggctggcaacgcccgctgggccccgggtggggttccagggaggccggggcggatcgcggcgcccggaccgccgaaccctgcccagccccaggcgagcgcgtgtgcagcgggagccgccctccccggcggcagcccggcctggctgttccctcccgcgggcgcgcgggttccggagtcggcggcaccggggaagcctctctcgggcgcggccctccggagaggaacaaaggcggcgccctggccgcgctgctaccgccgcgcccgcaaggtcagcgcgcccgcccagagcccgagacgtcggcccgtgccccgccactcacctgcagcccccgctgcgcgctccgccggcccggccctgacccactttccgccccggagc

SEQ ID NO: 12858 - DNA, 5241 bp, Homo sapiens
cagcacaggtactgaaggaaagtggcgctggcacagaagcgggtgaccttcatgttgttccgggcggcggtgaagcacaccatcgggtagaatctcttgttctgcagctgggtggctgccacacctggaagggaggggcccagcctgaaccccaggcaggaaaggggccagctactgggcgcagcccttcagacctcacgctacagtcacccgggtgggcagctggcacagctgaggcaaggcagggtgcacgcgctggccttgccactccagcctggcctcactgtcccaccccgtgggaccctggggcctcaggcttctgggaggaaccctttcagaaaacctcagtgtcccctgggctggggcggggtggctgcctccctcggggtgacagctgagaggagctcaagtcctgtgacggcctcacctatacacttcctgttcttgaaaaaggtgagtgtgccgtgccaggtgtccaggtgcacgccaatgatggagccctggccgaaccgcgatgagaagctggtcttgtcgcccttgtggtggaggaggcctgggggcagccagggtcgcagtgagcccgggagctccaggctcggccccgccccaccctgggcctcacgcacccgtgtaggagaggccccagctgtcctcatccctgcccagcaggctgcagaacgtgtggcggtatttgtccaggtccacatccgacgtcccgatgcccaccatctaggaacaggggccaggcagagggcgcggggctgggctgccggagccaggttccccagaagcaccctgggccgaagcaacttaccatgtcggtgccgtagacgggagaggtcatcttgatctcccagaagtgctggccctcccccagctccttggtgccccggatggccgctgtgccgcagctgtactccatgtggaagctgaccttacggttgtcacagctcagcagggtggctgatgacttatttaagtcatcccagacccagtcgaaatctgcaagagaggcccaggctggggcagccctgagagctccatggggctctgccctgcccacccccaggcccgcccgcagtgcagtcccagcaggggctgggccccacgctcacactcgtcttcctctccgcagcggcagtccctgccccggtgggccgagtgcaggctgctacagaaggaggcctcgctctgcccagcacagtcacagaaggactcgccggtcacgggcaccgcactggggatggatggcggcagcgtggagtactcggggtcggagtccgagtcgctgtgctgggagagaagggccggctgttactacctgttgcccgctctctaccctctcacccttgccctctgtccctgtcccaccctgtccctgacccacccaggaaaggatgggggtccaggcctccagggacttcacagtaccccgagcgcacagcccaggctccctcccaacgggctccggctctgccccattctgcatgaccaggagggccctggaggcccagccacagagcagtagccaaggctgcctggcctccaagtggtttctagacggtggataagccccaggtccaccccacctgcccagagctgagatggtgtggacaccttccctgctaggccagccctgcaggggcccccaggcaaggccaccacccccacaccaggcccagctgcagccacccggcctcagggcagtccccaccacactgtggcccaacgaccttcctgttacctgagcagacctggctcaccacagggtcctactgcccagtgcccactacaggccccgcccctcctggtgcaggtttcagctgtcacctccctgaggcttctccagccccttcacccctgttccatttttcttcttttgcttcactgaagttctccttggtcctgattcttggcctcctcccaccagaacgtgagctccttgtgggaggcagtgcccctcccagcctcctccctgtcacagactgtgtgggggccacccaggggctgaatggaccagggggtcagcagggagagtgctaagtggtggcggggggcctgtggcagaggccttgtgacagtgagggttgagggctggtccagagagatgatgtgatccccaggagaagccacaggggaccatgacatgggcgccaccagcttccaggtgaacgtggacctatcgaaagccagcttcagggcaggacactgtcctttctggaggggatggccccaccccacagacaaggcaggcccagacaactctaccccactgcctagaagtgcgggtccccagagccagggtagaccccctgagtcaggagcccgggcacagaactgagcacctgcactgcaggcccagggccgggttccctggagaaggagaaagactgaagccactgcctacctcctgcccacaacagactgcaggcccatttggtgacacaggacaagcagcacatgtgtcgaacactgccgagcccgcaggcacgcctgcatcccacagccacgagcctgtgaggctcaggcatgtgacctgcaggagctggaggcgggcgggaaggcaggtgggggcctctccctggctggagcagggagctccaggagacctcaggacggcccccacccggtgggtaaggaccctgtttcccaatttgcccccaaggcctaatggacccaccgggcttagggagtcctcactcagaggagaggagcccacccctcccaggacacctggctgagccggaacagcagcgcaggggagctgtgacagcagagagcagcaccaggtcacacaagcagccgccccggaaggacacggcccatggtgacagaggacaagcagcatgcgtgtgtcagacactggcctggcctgtggacacgcccgcgtcccacagccatgaccctgcgaggccaggagagactgctccagggcacatgacctgtggtagctggaagtggggcagggaggcgcagccacactcctgctctggtccgagggagatctcaggaaaccgactgggaaatcaccccccacagggacccccacccctcccagcctcactgcgcccgtcaggccaggcagctgccctcagggtctgccaaggtgggggtcaggggccatgggggcaggtagctctgcctgcaaagcccacaagcatgtcagatcacctgggctgcagacagacaaacacctgagctgttctgaataccttcaggttcctggcctccctgagcaagtgcagaaatttttaccttcaaggatcagggtttttctgtttgtttgttttttaacacacatatatgtgaacaaagagtatgcgtttgtactggcagaagaagcgtctggtaagacaaccagcaagttaacaatggtcacctccagaaatgggctgggtaaaccaaagaatttttttgtttttgttttttttgagtcagggtctagctctgtcacccaggctggaacgcactggtgtgatcacggctcactgcagccttgacctccctggctcaagcaatcctcccagctcagcctcctgagtcgttgggactacaggcacgtgccaccacgcctgacacattttttaaatttttgtagagacagtgtttcaccatgttgcccaggcaggtctcaaactcctgggctcaagtggtcctccagcttcagcctcccaaagtgctaggattataggtgtgagccacagtgcccagccccgtagtggagaatttctgttgaatgaaccaaaagcaactgccaacctctccatgcaccatgtgtttcagaggagaaagcacagtgaagaatgcagtgtgttctgaggtcctgtcacccctgaggctgtgtgtgtcctttgccaaattaaagagtcttactgaatgcggtgcatccaggagacaggcccaggtttggactggtcctctagcctcagaagcatctttttctccgactgattccgtgttcaggtaatgtctgcctgcctgcctagggcatctccacaccttaggccagccacgtccgcctcgcccgctggaacctacctgcccatcagagtcgtagccccagttagtggagcctgctagagccacggcccgggcatctgcgtctcggcgggctgcactcaggacgaagtgccaggccctgctgttccgggggcgtctggccatggtggaaagaatctagaagaaaacacaggctctgggcaaaggaagactcacagcactcccagccctgagcttccaggctgggccacggacccactcaaagtggggactgcaggggccgcaccggtgcccagccagggctccagaacgcttcaggagcccgtacctcactccaggatctgagcagctcaataaaacccaggtagatcctgtgaaacgccacccagacacccatgactccggaatgcgaatcccagcccctctctccggttccacctcacgaacctggctgccccgcccgcctgtcccgcaggcatctaaaacctccactcgctcctcctctgtcgtccggtttgacaaatggcatctccggcctcccagttcctcatgccagaagcaccgtgaccgctccccgacaccttcccctcacgcccggcccgaccgccgcacccgcctgcatcctcctcccgccaccgtctcctgggccgcgcagctcgccttcccctccgctcgctaccgccagggctcctcgtgaaacacaaatcttaaaacctgctcagcgctggccgctgttatggtataaaatgcaaaaggctgcgagggccaggtctgcgcttcccaggccacctgcctggcacctccctcgccagctccggggttcccgcctagccttccagggccgacccctgcgccgggctcgcggctggcaacgcccgctgggccccgggtggggttccagggaggccggggcggatcgcggcgcccggaccgccgaaccctgcccagccccaggcgagcgcgtgtgcagcgggagccgccctccccggcggcagcccggcctggctgttccctcccgcgggcgcgcgggttccggagtcggcggcaccggggaagcctctctcgggcgcggccctccggagaggaacaaaggcggcgccctggccgcgctgctaccgccgcgcccgcaaggtcagcgcgcccgcccagagcccgagacgtcggcccgtgccccgccactcacctgcagcccccgctgcgcgctccgccggcccggccctgacccactttccgccccggagc

SEQ ID NO: 12859 - DNA, 297 bp, Homo sapiens
gtcttttgtttttgagacggagtctcgttctgtcgcccaggctggagtgcagtggcgcggtctcggctcactgccagctccgcctcccgggttcacgccattctcctgccgcagcctcccgagtagctgggactacaggcgcccgccaccacgcccggctaattttttgtatttttagtagagacggggtttcaccgtgttagccaggatggtctcgatctcctgacctcgtgatccgcccgtctcagcctcccaaagtgctgggattacaggcgtgagccacggcgcctggcccag

SEQ ID NO: 12860 - DNA, 296 bp, Homo sapiens
gtcttttgtttttgagacggagtctcgttctgtcgcccaggctggagtgcagtggcgcggtctcggctcactgccagctccgcctcccgggttcacgccattctcctgccgcagcctcccgagtagctgtgactacaggcgcccgccaccacgcccggctaattttttgtatttttagtagagacggggtttcaccgtgttagccaggatggtctcgatctcctgacctcgtgatccgcccgtctcagcctcccaaagtgctgggattacaggcgtgagccacggcgcctggccca

SEQ ID NO: 12861 - DNA, 2725 bp, Homo sapiens
gaaaccctcagaaatcaacagtagaaaacttctctaaaacagctttggcctttttgcatatgaatgacttttactgcgtaaatcagttattttgcttaccatcctagtcctctgctttccaccccaaatccttgtttatgtgtgtgtggttttgtttgtttgcttgtttgtttgcttgtttgttttttgagacggagtacctctcggttgcccaggctggagtgcagtggctcgatctcagctctctgcagcaacctccacctcccgggttcaagtgcttctcctgcctctgcctcctgagtagctgggactacaggcgcgcatgccaccatacccggataatttttgtatttttagtagaaatggggttcaccatgttgaccaggctgatcttgaactcctgacctcaagtgatccacccgccttagcctcccgaagtgctgggattacagcgtgtgagccaccacactcccgcctgcgtgtttgttttttaaatctctcttcttagggtcatgagatttctcattaatttcacttagagctcctggagagaaaagcctctattattgtcactataacagtaaaaaaagtgtagagatttttttttttcttttgagacagagtttcgctcttgttgcccaggctggagtgcaatggcgtgatctcagctcactgcaacctccacctcccgggttcaagcgattctcctgccttggcctcccaagtagctgggattacaggcatgtgccaccacacctggctaattttgtatttttagtagagatggggtttcaccatgttggtcaggctggtcttgaactcctgacctcaggtgatccacctgccttagcctcccaaagtgctgggatcacaggcatgagccactgtgtccagcttttctttttcttttctttttttttttttttttgagacagggtctctttctgttgcccaagctgaaacagtgacacaatcatagctcactgtaacatcaaacttctggggctcaagcaatcctcctggctccgccttccaaatagctaggattacaggtgcacatcaccatacccaggtaattttttctttttttacacgaaaatgtctcaacatggatttttttttcttttttggcagagatgatgtctcactatgttgcccaggctggtctcaaactccctgcctcaagccatccttccactttagcatcccaaagtgctaggattacaggcgtgcagccgcacctacccccaagaaagcttttttttttttttttttttttttttgagacagagtcttgctctgtcaaccaggctggagtgcagtggcgcgatctcagctcactgtaacctctgcctcccatgttcaagcaatcctcccgcctcagcctcccgagtaactagaattacaggcacatgccaccacgcccggctaatttttgtatttttagtagagagggggtttcaccatgttggccaggatggtctcgaactcctgacctcaagtgatccacctgctgtggcctcccaaagtgctgggattatgggcatgagccactgcacccggcccccaagaactcttcaaatgcacctagtgtcacaagaaaagatagttaaactgtgtctgaaaaagtggcttatgtggggaaatttgtgatggatttagggaaacttagggtaaattttaaacataaggccttttgtcagatcacctacattcctcggattgtgcgtgggtttgccgcaggtgcttgatgtgacaaattacacagcttctattgcttcatttgatcagccgcctgttgactttcagccaagtcctgcagggttgcttctcagattgtatctttctgcaagacaaagatgttttcatagtctctctttaacttctcccttttgtggctattaatttatacttatatgtttttcaactccttatttttgttttctctttataaaagttttaacgtgtgctattcttgagggaaatactgatgcatatctaaactttaggggtgtttttcaccctggctacagacactcggtaaataatttttcaggtgatgggaaaacacatcatcatgagaatgtagcaacttttattttgcagtaactgttaaaattgtggccacagtgctcagtaaaaggggaccttccccctgtaggtgtttggggaggagtgacgtcctgtcctccattttgttagtaacccacttatggatggggcattatcacctagaaagaaaagagataccatggtatgcagttacagggagccagagcaagagcaagacaaagaaattcccttacgtcttcaatgcagagccggcatttagacctctaccccaggcaggacccacaaatctttggcagccatgagcacctgttttgctcctgccttcttcctgttggcaattttgggttttggggttttttttttttagacagagtctcactccatcaccaggctggaagtacagtggtgcagtctcggcccactgcagcctccgccttccgggttcaaatgatcctcttgcttcagcctcccaattagctgggactacaggtgcgcaccaccacggccagctaatttttgtatttttagtagagatggggtttcaccatattgcccaggctggtctcaaactcctgacctcaagtgatctgctcacctcagcctttcaaagtgctgggattatatatatattttaaataaatgaatagaattc

SEQ ID NO: 12862 - DNA, 2726 bp, Homo sapiens
gaaaccctcagaaatcaacagtagaaaacttctctaaaacagctttggcctttttgcatatgaatgacttttactgcgtaaatcagttattttgcttaccatcctagtcctctgctttccaccccaaatccttgtttatgtgtgtgtggttttgtttgtttgcttgtttgtttgcttgtttgttttttgagacggagtctcactctgttgcccaggctggagtgcagtggctcgatctcagctctctgcagcaacctccacctcccgggttcaagtgcttctcctgcctctgcctcctgagtagctgggactacaggcgcgcatgccaccatacccggataatttttgtatttttagtagaaatggggtttcaccatgttgaccaggctgatcttgaactcctgacctcaagtgatccacccgccttagcctcccgaagtgctgggattacaggtgtgagccaccacaccccgcctgcgtgtttgttttttaaatctctcttcttagggtcatgagatttctcattaatttcacttagagctcctggagagaaaagcctctattattgtcactataacagtaaaaaaagtgtagagatttttttttttcttttgagacagagtttcgctcttgttgcccaggctggagtgcaatggcgtgatctcagctcactgcaacctccacctcccgggttcaagcgattctcctgccttggcctcccaagtagctgggattacaggcatgtgccaccacacctggctaattttgtatttttagtagagatggggtttcaccatgttggtcaggctggtcttgaactcctgacctcaggtgatccacctgccttagcctcccaaagtgctgggatcacaggcatgagccactgtgtccagcttttctttttcttttctttttttttttttttttgagacagggtctctttctgttgcccaagctgaaacagtgacacaatcatagctcactgtaacatcaaacttctggggctcaagcaatcctcctggctccgccttccaaatagctaggattacaggtgcacatcaccatacccaggtaattttttctttttttacacgaaaatgtctcaacatggatttttttttcttttttggcagagatgatgtctcactatgttgcccaggctggtctcaaactccctgcctcaagccatccttccactttagcatcccaaagtgctaggattacaggcgtgagccaccgcacctacccccaagaaagcttttttttttttttttttttttttttgagacagagtcttgctctgtcaaccaggctggagtgcagtggcgcgatctcagctcactgtaacctctgcctcccatgttcaagcaatcctcccgcctcagcctcccgagtaactagaattacaggcacatgccaccacgcccggctaatttttgtatttttagtagagagggggtttcaccatgttggccaggatggtctcgaactcctgacctcaagtgatccacctgctgtggcctcccaaagtgctgggattatgggcatgagccactgcacccggcccccaagaactcttcaaatgcacctagtgtcacaagaaaagatagttaaactgtgtctgaaaaagtggcttatgtggggaaatttgtgatggatttagggaaacttagggtaaattttaaacataaggccttttgtcagatcacctacattcctcggattgtgcgtgggtttgtcgcaggtgcttgatgtgacaaattacacagcttctattgcttcatttgatcagccgcctgttgactttcagccaagtcctgcagggttgcttctcagattgtatctttctgcaagacaaagatgttttcatagtctctctttaacttctcccttttgtggctattaatttatacttatatgtttttcaactccttatttttgttttctctttataaaagttttaacgtgtgctattcttgagggaaatactgatgcatatctaaactttaggggtgtttttcaccctggctacagacactcggtaaataatttttcaggtgatgggaaaacacatcatcatgagaatgtagcaacttttattttgcagtaactgttaaaattgtggccacagtgctcagtaaaaggggaccttccccctgtaggtgtttggggaggagtgacgtcctgtcctccattttgttagtaacccacttatggatggggcattatcacctagaaagaaaagagataccatggtatgcagttacagggagccagagcaagagcaagacaaagaaattcccttacgtcttcaatgcagagccggcatttagacctctaccccaggcaggacccacaaatctttggcagccatgagcacctgttttgctcctgccttcttcctgttggcaattttgggttttggggttttttttttttagacagagtctcactccatcaccaggctggaagtacagtggtgcagtctcggcccactgcagcctccgccttccgggttcaaatgatcctcttgcttcagcctcccaattagctgggactacaggtgcgcaccaccacggccagctaatttttgtatttttagtagagatggggtttcaccatattgcccaggctggtctcaaactcctgacctcaagtgatctgctcacctcagcctttcaaagtgctgggattatatatatattttaaataaatgaatagaattc

SEQ ID NO: 12863 - DNA, 358 bp, Homo sapiens
caggtgtcattgttctgttgcagcatatggtgttcctgacagatcccttgtctttctggttcttggttttctcatatgcagaatcttgttatgaacaagttgtgttgaaagttcacattctttaagtatgtatgttggtcatctctgttgaaaatgatagaaaaatcaccttcggtagaaaatttacaaacaggccgggtgcagtgtctcatgcttgtaatcccagcacttcaggaggtggaggcggttggatttttgagcccaagactttgagaccagccttggcaacacagtgaaaccccatctctaccaaaaatacaaaaattagccaatctcacagcccagtctcaaaataaat

SEQ ID NO: 12864 - DNA, 358 bp, Homo sapiens; identical to SEQ ID NO: 12863

SEQ ID NO: 12865 - DNA, 1248 bp, Homo sapiens
aaaggactgatttgggagctgcagacatttcttctgtagacacaactgttatttccagaatgttctatttttagatagacatttggctccaaagtctccattcaaaattcctgagaggggaaaaaacttttaaaatactacttttttttttttttaccatttaaaataaaatgaaagtgaccttctgtttataaaaatctttgtctgcatctctgcttatttccttagaagagattccaagaagcggtgagtgatttcacggcagcagagggttgggacatattacgggcgcggatccctcttggagtgagatgactctccggagagatttagtcgtcaccctcgcgtgtgaggctgcgtcacaccccagggatgtgtctatcaagatggaagatcttttacacgctcttgattttgtttgcctttttttctattactagtgagaatgaaactttttatatgattattatccatcataatccaacacaaattactgcttcatgttcttttactttcctgtgaaggttttagtgccttttaaaaattgctatatattaagcttgttaatactttccatgctgtatttgtggccatcagtttccccgggcacaggcctgcacattttgccttcacacgctgggtggtttttcattttcacttctatttctcgttcttctatcgttttatgttcagacgggtttctccgtgtagaaagcagtttatgaagatttactttcgacagtcttctctctactttctacagtgaattctctgatgtgtctgggagtttgggggtctgggtaagagtcctcctctcaccctattctctattacgatccacagcctcatgctttatgagattggtggccgggagcgggggagatttgcggatcccccaagccagactttatccccctatccctgcctctggatcccacgtacaggcctgggaactccctgtgggtaggggccaatggtctcgcactctcacctgtaccccagggctggcacaggatggtcaaggagagaggctgcccaagcgcatccctctggtgtccccctgacacgcctccaaagtgagcaggtaggtttcaacagccccacgttgcaggtgggagatgaagctcagggtggagaccagtatctcacagttctctttgcatggccgggtacttgttagtcaactgatcaagtgaaaattctagccccagaggcaggagaatccggaacaaaattaaaccagccagg

SEQ ID NO: 12866 - DNA, 883 bp, Homo sapiens
ttttcccttccttcttttccttccctcccttccttccttcctttcctttcttttctttctttcctttctttcttttttttttttttcaagcttttactatgtgcccaggctggtcttgaactcctgggctcaagtgatcctcctgccttggcctcccaaagtgttgggattacagtcgtaaaccactacacctggaaggcatttttaacttggctccgtagagttgaatgagcctgagaactagggtaggaaaaaattacaattgtattgtccctaacctctaactgaaatttagcatcactctcaagtacgagcgtaggcaacaaaccacagaggtattatcagccgtacctgtgaccttgtcaccaacagacgtcacagatacttacatatcacattacagttgctgcagattgctctaaatatcttttatgctcatcacaacttcaaaaccatggttgtcattaggcccaatgctagatcttatttaatacattgaataaagcagcacatttaccacaatttttaaagtattttgctatgttttaatagaaatggtttctattgtaatactttgtatttgattttataccttaaaaatatcattgttctgagaaaggtgtgcgggcttcaccagctatcagaggggcccacagggcaaaaaaaaaaaaaaaaaaaaaaaaagcgctaagcagctcaacctgaagtatcacaggccctaccactccctttctctattccctgcacctgctggaattttctcacaatgcatatgcttttaataatccatctactcattttgtctccttctactagattataacctccccaggggcccaagtttttgtcttgttcatgcagtgtctccagcccctaggacggc

SEQ ID NO: 12867 - DNA, 10563 bp, Homo sapiens
tttttttcttcttctctgaaaaaggtagtgcccttcgtgacttccctgtcccttcccttggcttctccgaggcctggccaccggcagacccaggggcgttggactcgtggctccggaggatgaggatgtcactggcctgaagaaaatcaaacaaggagagttgagtgatctgagcaagcgcagatctggaattctaaaatcgcagggaaccgggggcctgaaaagtcatatatattcctgccaaacagtcacctagcatgcacttgggtccttccagggatatgacgaccattgcctcctccaactctgcatctctggtcagctctatcgtttacaaagttgctgctagagtaattctgtggggcagcccgagctgctagaggccttgatgcgcctgacaggggatcttggtctctgggttaatgaagcacctacctgttgatgttttctgtcatttagtccgctcatgccctgttctataaatgagattcaggcccctgtgatgggccagatgctagggacaaagaggttgacacaggcatccctgccctcagagctgaggatctggtggaagggacagatgcgcaggtagctacttcaggacagcgcactgcagggacaccaaacagggcaagggcaggggtcagagtgcagagcagagggagcagaggtgacctcggctggggaagccccgggtggccatcagaagtggcaccctcatgggaaagttcacaaaagtcaacagaactctgtagagcgctacacagagcacagctcttggtgcaggtggtcgaggctcagaagtgggcacacagccgtgtgtttacagtttatgggagctctgtaagcatgagtgtactacacacattccttttttttttttttttttttgagatggagtcttgctatgtcacccaggctggagtgcagtggcatgatcttggctcactgcaacctccgcctcctccacctcctgggttcaagtgattctcctgcctcagcctctggagtagctgggattacaggcgtgcaccaccatgcccagctagtttttgtatttttaatagagatgaggtttcaccttgttggccaggctggtctcgactcctgacctcaggtgatccactcaccttggcctcccaaagtgctgggattacaggtgtgagccactgcgcccggcctactacatacatttctaaaaaaaaagactctaaaaaagcagcagctccccaataaaccccttcccctccttacccctttctgggagaactctccctggcaaggagcaactatggccagtagtcttgtttcttggcctgtgatatggtggacagagcactgcactaggagtccaaggacctggggcaagtcacttagcatctctgaactgctttcccccatctgcagagtagaggttaactctgcagtgtgaggaactaatgagataatggaaatgaaagcactttgcagagatcatgcctgagggcctatgattgtcattcccatggtctcagctcagtctcattcttgtcagggactctggctctcttaggggagccctgtctgcaaaccaccaatgctccctcagtgacccacatacctactgggttttcacaaaacctttttccctctgaatctcagatacagaagcagtagagtataaaaattaatcgcagactctggattcaggctgcctactagctgtgttatcttgggccacaatttccccatctataaaatgggaataacagtaatacctaaccacatagggtagtgaggattaaatgagttaacagcacaaagtacttcacacatttcctgctattatgattataatgaggatcacagtcctgctctaccctccctcccacgcccccaggcccagctccaccctgcttgccctgggctcagcccatggtggtcacactcaccgactcattggcctgtagtgtctgcgtggctttgactgccgctgcccgcctgctgcgctctcgcccctcttcctgctcctccttctcttggatctctggcacctcctcctccccctccttcctgggctccttcacctccctcttgggctccagcctctcttcacttggggactctcttctgggaagaggcacccttgggaacttttgggaagtctatggggaacaagaacaagggcagtgagcctagagctctgtctcactgctgtagcacagattctgacccggccggggggttcaccagccccagctagtcctgctcgcctggctggcccagcatagtcttctgtactaggactctggactctgtccccatggcatagtagccatggggacagaagagtctcaagccctgggagcacctgagagagaacgaggggcaaggagggtacataccagtcactccccattgccacccatcctcctggacagatgaccaggaggcatcctcggcaatgatgtggtgagccaggcagaagccttgagttccaattccaaactatctttgtaatgctttctgtagctctactaccttcctgcctgcaaaatgggcagcaaaccactccctgtcttaccgtagcatgtcaccaagcgtggatttgcaatcccaaaaatgatgctaggtggatacatggacataggattaagtaaccttcccttttaattctctttcaatcctgattatgccaaggactcagtctctggttgctgctaatgtgtcttttatacttctctagacttgataatctctttaacaaagcaaggtcagccctcagtctcagccttggcaggtaacacagcatctagctagaattcagtaatactggttttcacatatatttttaccagtaccttctatttatagcacacaaccttggttttctatttatcactgtgatataaaacttcccttctgagtaaaaaatgagttgacttaaaggaaaatattaagtaatggcacaagtagtatatgaatatgacaaaaattctaatggcgacacatggtaggatgcagatatggcagaaatcaaaaaggtgatacaagaatgactgaggtttgagaaacagtgttagaggtctgctaagcggagataggaagatgatgctggtgtgaatcttgtgggaaaattaccctgtgtatcaacacaatgtattattactatgacaccagcagtatagagaggagaacccagcggtccagggctccttgcggctgtcagggacactgtcttcctcaacctgccctctgcaggctcctggagagctcgggctcgggctcccagctcaggcctggtcccagacccagcccaggctctatgcagctgaggttggaaaaggagtcaccttaatatccacttcaacctcttcctgggccgacttctcatcgctcgtatccacatccccaaaggttagagtcccattgcggccgattttcacctgcttcttgtaggtgtagtagaactccacgcactgggccacggtcttggtctggatctggtttgaagtcaaaactgaggtcagaaccctctggtttggctcatctgcctgtggagaatccagcctttctcgtccctgcatctttcccttaacttcaagccaaaatgaaacccagccaacccaggcaatacaagcatttttccaatgcctgctctgcaacaaaccactgatcaattaatcaatgcttcagcactatttaaaataagtaaataaataaaaaaagctataaaggacaatgtcggaaccactcgggagatggcaatatggattgcatatcagagggcattactgtatttttttttcttttttttggagacagagtctcgctctgtcactcaggctggagtgcagtgacgcgattttggctcactgcaacctccgcctcccaggttcaaataattctcgtgcctcagcttcctgagtagctgggattacaggtgtgtgccaccacaaccagctagttttttttaaatatttttagtagacatggggttttgccatgttggccagcctggtctcaaactcctggcctcaggagtgatccgtctgcctctgcctcccaaagtgctggaatcacaggcgtgagctacctcgcctggcctgaattattttatcaggttaaatttcgtgggcgtgctaatggtactgtggttttgtagaatatcttggtttttaggagatacgtgctgaaaggttttagtcatgtgacaggatgactgtaacttacttttaatgattagctgaatcagagaacaagagagagctgtatatgtgtgtgtctatgtttagacatagagaaagagaaagcaaatatagccaatgttaacgattgctaaatctaagtccggggtggatgggtgttcattctactgttctttccattttcctctaagtttgaaatttttcaaactgaaaagttgagggaaaaggtctgggcaccatctacatccaaagccagccctgacctggcaacacagacgcttttcattaatccaggcaaacaatttcatttctctccagggagcagtggctgagaagtgagcatacagaaatgtcacagtgtcccctgtcgggggaggaactcaagggaaactcacaagaaagccctggaaaacctgaggaggaagcgaaaggcctaagtcttcctcctgactctgctaccacacagctattcgagcttaggcaagtcactcacttttctaatttcagttttttcatgtgtaaatagcaaatggggttaagtaagactagatgatctccagggacctgcctctcaagctctgaaattctagctctcccattgcataaatctatttggccactgggtttagtttttgggcaactttcccacacccagaggctgtttcctctgacaccaccacacaggctcgcacattgctcagccaccgctgggctgggagctcctgtccagagaggccaggggtcagtgtgggccctttgtgtctgaggaggaaacagacatgtttcatctcacagaaatggccaagtcacacatgtattaattaggccatttacacatttactgtcaattctctctgaccctttgtttgactgactaaaggtctgctcatttcattaggcattaggggcgcctccgtgaatttcacgggcgtgtacttcccgtcagtattgcccaatcagggaatagcgtgttactaaaacacagcaaaggactcctcacaacagggcccttgtaggggaattcatcatcagcactttgtctagtccccagggctgttcccaatacaatctacaatcccaagaggaaagggcatgctctttttaaaaactcttttcccttggcagtccacacaattctctctccccacagcccagattttgtgagacagggctggaaagatgcaattccttggattagcaaagcatctgcttttccagaagaatatggagagaggacaagataaatctagggaatgtgggcttgaacagctgagttactggaaggcaactctgggtcaaaggaagtgggcagaggcccccaggtcagctccgcaggcacttgctggctctcagtggccttcaccccagggtgccctccccctgcatcttcctctggggaatggctcacctctacttgccaccctcctccgcatcttcctcctgcctattttaagtctgatgcccacttaggcctccttctggattgagaccccagagcttggccaccctaccctgaagtgaggaaaggatgcttagaaccaaaagggaaaagagacctatctttctctttcttgtattgtttaggaaattctctctgaggctactcagtagcattgacctgactgctttttaagagggattggtcactggcagagggagccccaaagtcacacaggcagctcctggccctcatttgccctgaaacagagcccagctcaccagcttctgcaccaggaagaaatccttcttgtagatggcaatgcctttgttgaacagcttcctctcggccatcttccactggtcagagcctatggggcaaagaggcagccagggagtgaggtgggcagggccctggccactgcagggcaattttgacaagcaaaaaagtgtgaggccatccgcccatggtttctgcaggcatcagagccggctcctcgtcccacttccatgtgcctcacagcctcgctcccttgcttgtgaaatggaaactaatatcacctagctcaccagctgtggtgaggattaaataagataatgcatgtgaaacccttggtgctctgcctggtgcagatgaaatgtagcactaacatgcatggaaaacattggctgttaggattatgtgactcggtccatgtccttcttaaagtgaccagaacaggacatgcactcctggggctaagttccaggtacctgatgccaatctggatggctctccatgggttcctgtccttgtggcctgggcttttttgcctggatggtctcccacctgcccactcccttctcccctcccctccagggcacaggaaacccctggagagctaccccagctttggtggcagttccctcactctgactcttggcttatctaccctcctcctcccgcccccacccagggctgtgactcagcactgagcagggccccatggatgctggagacctcttgaggctccaggcaccatgcccaccgcagccaggcccacctgtgtagtgataagttgccagcggatggttgtggggccgcaggggcttcttcagcagcagcttattcagcgtttcctggaggggaagtgagggaagggtcagggcactgacaggggtgtcggtggtggacggagcattctaggccctgataaaatcccgagtagggtggacacttactcttgcccccttaactgctgagagataaggggtccactggggtggtgagatcacagggggtggggctgcccagaaaacagacctcaggtcctcttaagagagtccatggccccaagggaggcagcactgctggagaaggctctcagcaaccatccagtctgagtccactgacccagaatcagggatgggaatggacaggaggacactgcacagcaaaacccggggtctgaaactagggctcccttgggtcaagcccctacagccccttccttagtcagaccctcctactggcctcaaatgtgcatgccagcagccataggtcctgagcagcagacatggatccaagccagcccccactgaggggccctccctctgctggggttgccttctcaccaggatgtctcctctggattcgtgcagacagtgcagggccagctcctggttggtgccagcaccagggaaaatgctggagcaggcggctgtcagcaggtcttccactggatccacaggagcatgaggagggaggggaggaaaccacgttcagggcggggctgggcagggtgaggcctggcccacccatgtgcctgccctcacttgctgcccccaggcccctcctcaccttgcctctgcttctcccggctgctctctaggtcctcccatggctgccacaccaagtcagccttgtggggatctgcagctgccagggcacggtccctcatcaaggggatttctgcctggaaccgggagcccacgttgatccgtctagaggagtgaaaagggcaggaagtgaggcctcaccttgcggggacggagaacttgatgatccctcagggtgggaagaagatgagggggagccggcagagcaaggcctcagctaggtgtagggagtctggcttctaggggcttgggaggacagcctgacctggcaccaccagaaaggcaaggtccagaggctggagaggggagaagcagctgcaggtttacagatgggaaagagcctctggacccccctttcaactctcctagagataagttcaagctgagccggtccttgcccttccctgcaacttccacacagaggcagggcggggacagcaaagcccagggccacatacagaagctcaaggaggccctctcagccctctgcaggccccacggaaccctcctgttgctcccagggcccacctgcacacactgcaccagtgtggccacccacacccctcggccaggggcagggctgcacttacggctcgatgctcactggggtggcctcccccatcacagagaggacaggcggggttacttcagcactgtctatgggacaaagagcaggttgataaatagcacccccctttcagcaaagcacccccaatcctagtggctgccctgtatgtgcaagagtcacagtggtgacacacagagctcacgcagggaacacaggcacctgagtcctggctctgcagcctgtcacctacgaaaacgcaggcccttcactaaatatttgggtgcctcagttttcacactcaccaaaaggggctatcactacctgtctcctacggttaatgtgagaactggataaaataatgcacagagcctggcactcgataaagattattattactgcttctactaccaaagccatatccttgcccccagaagctccaacactaactccaacataaagctgtggttttctagtaaagagactgaaactttgagcacactagggaggtggtgaaggggatcgctgttttatagttatcgtctcacttcctctttggattttctgcctcagtttctcccaagctagttttttttttgtttttgttgttgttgttgttgctttttgagacaaagtctcactctgtctccgcccaggctggagtgcagtggtgcgatctcggctcaaggagttgaacctccaagttcaagcaattctcctccctcagcctcccaagtagctggaattacaggtgtgagtcaccgtgcccaggcccaagttggtcttcttaaggccccacatgatcaaaacactcctttgcttaaaaaaaaaaaaaaaaaaaaatctttgctctttactgactccctcctgcaatgtgagataaaacctgcaaccctcccctcagggttcaaggcggttccgcttccatttgtacctcccaccacccatgtgcctggacctgcatcctagctgactgcttacctcccaacccctcactctccctgcacggtcccatctacaggcctttgcaccagtcatttcctccgcctggtgtgtcctccctgccccccgccctcctccatcgctgcggctcagctctggccccacccctcttgaatacagtcctcaccatcccaggctagctgctggggctttgctcactggctgcagatcccacactaccgggaacctctgttttttcaactccaaggctttcatgtcaactccctaatgaccttgcattctctatagaacagaccatggtgtcctgtacattcttggagccctcacaggacccagtacaaggccttacgcccgagtgttcggtagatactcgtggacagactgacctctcgctggctgccagtctgatctctacaatgacttcctcttcctacacagcctagccagggagaagcctccccaggaagcagtacagaaggctggccagcctagggcaaacattttgcatccacagacaccagggggcaccagagagctacaccatgggtgaggtcacagtcaaaggttaattggccaaaggcatctataagctagctacttccacttaatcctctctaccaccctaagggattggattatcccattttgcagaggaaatggatctctttatggagtgggcaacatttttcagcagtacatcaccccaagccagcccaatatttccagaatgtctgcttttggccaaaaagactgttcgagagccccagagactagatctgccacaaaggactatgagcaaacaggatggcctgggcatgatgttccagctttatgtgtgctaatgcacctgagcctaggaagtggctattaggttgaaccaaaggaaactactatttgtgaatccaaaaatagttgaatattggcagtttcatcatcaaccaagtaatactaatatccccatcttaatactgaaaaaactgaggcccagggagttgaagtgacttgcaaaagtggatgtaatagtaaatggtagaattgagatttgaatccaagcagctgggcgggccccccacccctccttgttgaaccaggacaacctccttctcaatctcagagaagacagagcagagctccttctcccagagtgttccagcccaatccccagcagccccacaggctgagatgcctccctgcccagtgccccagccccgctcctgccagggtcgcggagggaggtcactcactagtccggagcagcgtgcgatgggcactcttaggcgtgatgggaggaggggcagggatggtgctggttgatatgatggcattgaagtagaggccagagccttcccgcacagggctgaggatggggggcggcgtgtagggaggtagctcaaagctccgctcagaggggtggtcagctaggcgcacgggagagcgcaggtggctctggtatggggtgatgttggagtagacgggaggggcgatgaaagtgcccgccttggtggggatgatgaggggctcgggcctgggccg

SEQ ID NO: 12868 - DNA, 3270 bp, Homo sapiens
tgaatttttaaaaccttatttaataaaaggtttaaagatacagaagaacattcaaaagtaaataagttacataggtacattacaatcacatcagcaagattctttagtgtattaatttttttcttataaaaagcacacaaaaaataaaatcttcagtctctatcacaactgtacagcaaaagaggtaatatttatatatgtacactattttaatatgtaacagtctttttaaaaaaggatgccacaggcagcaaacacacaaaaggcagtgtctgatcatttttgtttcaaaataaaaggaatatacttatttatatgctattaaaatatctgtacaataattacagactgtcaaggctgttcctgtgctctgtcccctccaacaaagccttcaacttagagacaaatgaggaaaaagtgaaacagctgcaaattgttagaagcaaatattaacatagcaaaatgtggggaggacacaattgttttataaaaatatccctacttcctgtaaacctatggagttaggcttgccagtctgataataaataccgtcccagaaaagcgagccccagtgaaaacaactaaacaggctgaggcttgagtatgtgttgtattcctccttcatcttaacatctggcacatgagaagaaagaggttaggtcactgaggcagttaaatataggtgatccctttagacataagcagcagaagaccttggtgccaggggtggaggcgcggcagaaggggtggtatgtaccttagctgtgaggggggctgctgaaggcatggaggacagtaatgacggctgtgcctccttggatggtggagacctcagaaatggtctgcaacacaggcactaggtcagtttcccgcccttagctgaatgcagatggatgctgggagatggatatggtgagatggtgtggggaggatgttagaaagctggaggtgtttatcacttctcaaggagctctgaatatagggggaaaaaaacaacaaaaagacaagcccagggagaaagcaccattaaggatatacctatgccagcttctatagctgcacctgctttattggcaggtcacttgccacaattgcatctgccctctaaactttttaattttcacactgtatcctagacatgaatgcataaaatacagtgtctggcgggataatgcagagaggtaccatcttgattttccccagttacattcacctggtctggtctctgtaagcttagaagagtagaatcactttattttttaaagacttccggccaggcacggtggttcacgcctgtaatgccagcactttgggaggccgaggcgggtggaccacctgaggtcaggagttcaagaccagcctggccgacatggcgaaaccctgtctctactaaaaaaaaaaatacaaaaagattagctgggtgtggtggtgtgtgcctataatcccagctactcaggaggctgaggcaggagaattcttttaacccaagaggcggaggttgcagtgagccaagatcacaccactgcactccagcctgggcgacagaatgagactctgtctcaaaaaaaaaaaaaaaaaaaaaaaaaaattttttttccaagtacaagatgttaccactgacaaaagggtctcatatgaatgatggaggtttctgttaccgtatgcccataaaggggcctgaaaccaaatatgatttgaatagaaaagaccttgggaaacataagtagcactttggggctaagctgcgaaggcactcgtattgtacaagtaatttcgaagagagcctaaatttgctacccccctgcttctacagggtataccagatttttgctgtcttgggacactgagctcatggaagcctgtggaggaaactaaccggtaagctggggatctaggtagtcatccaagagtctggagggagaagaaatttgttacttccacagctggggtcctgtagaaccatactaatgtacaaatggatgctgaaaaatacctgcatagtttcaaaacaaaactccctctccactcccagttactgacatgatgcttcttggctatctcataaggagtagcagtatgaatactttctggctccttcctaatacgttgacctgtcatacgcgcattcacttagaatttcttttgcacaactaaagttgaataagatcagaaaaatagctgagccccgctatgggactggaagtgaaggggcctccagaacctcctggccctttcacttcacccatgccaaatatggcttcttcaagccagaatccaggccccataaaccaaactagaattctggcctcttgccaactcttccctcaggcaaagcacagccagagaaggggcagcaagaactgccttaatctcccttgctctgtgtgggtctggtgacaccctccaccttcccacgctctttcagtgttgctatcattcctatcagcaagagcttccagagcaaccaggtgagggaccttagggccttgggaatttagggggtggggataggggatgtcaagatgcctcgttttgggataaatgcactcgggcctctgaaaagcaggaggcccctggtccctgagaggatgttaaaaattaaatactaagaataaataaatagctcccaaatgacacgagtcaaggaatgaaggctcctgtccaatcgagttaggagacctctccctcccagggaaggatccagaaatctccaaagtgcaggcctgggggctgggttgtggatatcgacactgggtagggtgcggtggggttaggtgtagctgctgaggtcagagcagaggcaaggaggctggccccaggaggggcaggctgagcctctccgggacctgctcaaggcgaagcgcccttggcagcctccaggacccaaaggtattcagccaaaaaggtgggaagcaggaagagccaggcttgtcaaaagctctctcgggcctaaccctgcagcttccagcctccgtacagctcccttccctgcagcaggatgagtgctttggacaagaacgctagcccctcccccaacgctgagaaaactttctagccctagcaaggccgccagcaagcagcaaagggagagtacctgccgcggcctccctcccaaggaggaggtggccactcaggacacggtcacgggagcagctcagacaggcctagagactgcagggacagcacaggtgtcaggctgcgccccttctcagagaagcccgcagactccctccaagagtttctttttctggggcttggggcagggccgtt

SEQ ID NO: 12869 - DNA, 1036 bp, Homo sapiens
aaataaagcattctatgaatttataatgccatgcaaataaaaatgtgctccagttattgtttgatgacctctggtcatggcttctcattcactgggcaagaggaagcccagaaccaataacggaagctcaacatagttctgcagcaccttcacaaattctgtactcagcatgcttgtcttattacttttctggtctttaggttggaaccagaaagtagtctcactcctggattctttatgtccttgaaagagttattgacatatatggtttccctttttggattagcatcatacttcatagaatcttctaggcttgtaggatctgtttcttagtttatagtaaacaaaggtctacctagttcatattgttcttttgtgaaaagtagaaaaaggtggcctatttggaaaaactcaccctcatgggccatgtcttagtaagtagaatgtgggactgaactcagcatccacatacccattcactcagatgctcttttgcaatggtcaaggagagtaattttagacattaattcctcttagaagatttaaacaatgtagtagtttgtaacatcacataattagatctcaaaacaagccttctgtattagtccgttctcacattgctataaagatctacctgagactgggtaatttatgaagaaaagaggtttaattgactcacagttccacaggctgtacaggaagcatggctgagaggcctcaggaaacttatgatcatggcagaaggtgaaggggaagcaaatacatcttaccatagtggagcaggagagagagagagtgaaggggaaagtgctacacacttttcagcaatcagatctcatgggaactcactcaccatcatgagaaccgcatgtggaaaatccactcccgtgatccaatcacatcccaccatgtccctcccccaaaacttggaactacaaattggcttgagatttgggtaaggacatagaaccaaactgtgtaattctgtccctggccccacctaaatctcatgttcttctcacatttcaaaacaaaa

SEQ ID NO: 12870 - DNA, 1036 bp, Homo sapiens
  misc_feature (60)..(61): n equals a,t,g, or c
aaataaagcattctatgaatttataatgccatgcaaataaaaatgtgctccagttatgtnntgatgacctctggtcatggcttctcattcactgggcaagaggaagcccagaaccaataacggaagctcaacatagttctgcagcagcttcacaaattctgtactcagcatgcttgtgcttattacttttctggtctttaggttggaacaagaaagtagtcttacccctggattctttatgtccttgaaagagttattgacatatattgttttcctttttggattagcatcagagttcatagaatcttctaggcttgtaggatttgttgcttagtttataataaacaaaggtctacctagctcatattgttcttttgtgaaaagtagaaaaaaatggcctatttggaaatctcaccctcatgggccatgtcttagtaagcagaatgtgggactgacctcagcatccccatacccattcactcagatgcccttttgcaatggcccaggagagtaattttagacattaattcctcttagaagatttaaacaatgtagtagtttgtaacatcacataattagatctcaaaacaagccttctgtgttagtccgttctcacattgctataaagatctacctgagactgggtaatttatgaagaaaagaggtttaattgactcacagttccacaggctgtacaggaagcatggctgagaggcctcaggaaacttacgttcatggcagaaggtgaaggggaagcaaatacatcttaccatagtggagcaggagagagagagagtgaaggggaaagtgctacacacttttaagcaaccagatctcatgggaactcactcaccatcatgagaacagcatgtggaaaatccactcccgtgatccaatcacatcccaccagatccctcccccaaaactgggaactacaaattggcttgagatttgggtaaggacacagaacaaaactatataattctgttcctggccccacctaaatctcatgttcttctcacatttcaaaacaaaa

SEQ ID NO: 12871 - DNA, 16018 bp, Homo sapiens
gccacaagaggagcctgtggtgcagggctcagcgctctatctggtagcccaccacgatgactactgcgtatggtacagcctgcagaggaccaggtacgtcgagcctcgtgggggtggaggatgagcctctgagacttgtatgtaaattccccatttacagatcctctggaggtgccagtgggttgatttgtgtctggacagaataacataagaacaaagatttgtgaccagtgtgtcagtgcccattcgtgtgtacccaggagaggctgtcatgggttgctggaatctgtttagagcagatgcgtaggaaaagtctggaattagcgggtgctctaagccctcatgcctactggagaccagtgtccagattcatgccctctggagacctgtggaggcgctcacagcccacgtctgtttgttcatctcctggcctagccctgaaaagaatgagagagtccgccagatgcgccccgtgtgtgactgccaggctcacctgctctggaaccggcctcggtttggagagatcaatgaccaggacagaactgatcgatacgtccaggctctgaggaccgtaagtgtccagccccttggcttgttgtggggaaaagggagaaagaagtttgtcccatgaaccccagcactttgcttatgatttgctgtttctttcctgtgtcctcttgtctatgagtggcttcagcgagcgcctcctgggtgggcactggagcagaaagcgggagagcctggggctggacttcctgagggcttgctctctgctctactgggagagcctctggctgggctcctgctggacacctttgccttgtcagacacagtcattgctgtgggtggtcacggtggattaggccaccccctcttttcatgtgttgtcacctttctaaaattttctaagatgtaaatctgatcatgtcgctctcctgcctgaaaacctttgctccctgctacctgtagcaggggactcggcttggggattacagatggggcttagagggagggtctcttgaggcccttgggggtgtgtacagaaataggtgtgaatgtgtgcattttgggggatggggggaggatccaagccatcctgagtttctctcagaggggtctgtcacccagaaaggcatccttgcctttgggccagtccaattgtgaacactcaagccttggaggctctcagctgtctgtgctctaaccagacagggaagaagcctgttgtcatggactggaaggtggcctgcaggtggtgcaggccttcagcggggcctctaggctgggttgaggggtgtctttcctgacactggggacaggtggggagatgtgagcaaggcgggcatgtttgtggctgggggtggttactgcatgaggacgcagggggatggtctgaggtctgggcaagtggagtgagaagggaagtatttctgacagcttgccagcaggaatcttctggcaaactggaggaagccctgtgctgagcttgcctgttccccgcaggtgctgaagccagacagcgtgtgcctgtgtgtcagcgatggcagcctgctctccgtgctggcccatcacctgggggtggagcaggtactgacatgcacccttgtcagcctcctgatgtgggcttgtgagttagagcattgcgtggtccgggtgcacaattctgtgatcaaggctctttgcaaaggccactgttgtgggcacagcatgctcgggtcaggggctggggggtttattgcctgtgcgtgcaggcaggcgtcaggcctcagagctggtgttcaggctgccccagggagggaatgagggcagggagggttgttcaggtgtgtcctctgtcttaggatggtcttgtcgcattttaatctttaatttcttctctgttaagtgaatatcttacaactaatagcgtggtgttccctctaggtgtttacagtcgagagttcagcagcttctcacaaactgttgagaaaagtaagtgagaattgttgttgctgaaatagtgagaggacctgtggggtctgggttgatggctttgaagtggcattggccccaggggaacaaaggagtggtggctcgcttgcacccctgtgttgtcttggttgctgcctggagagcagccagaggccttgggagctgtcactgaaatagaggcaggcatttgcactctgctttgtttttttgtgtctgaagaagtttaggcttttttcctcacttcacataagctactgttgcggtagaattaaatgtaggatgtgtttctgggacatcagtgctgagggagccagtgctcacagcctgatgggagatggcatttctctccctggccagtaactggtttgatttcctctccaaaggggaactcccttcaccagaactgcaggctcgcactgagtcctggtgtgcacatgcgggagaaatttcttttgcttttatcacattgtgctcctgatctcatccgtggtctataggatgccccccaaggagaggatttttccacaaagcagataaaagtggtgttccagaaccatttgccggaaaattcaaagcggagaatgcaactttgagagatttttttttcctgacaaacacaatactttagtatgaatacagtaattttacggttttctttctaagatcttcaaggctaaccacttggaagataaaattaacatcatagagaaacggccggaattattaacaaatgaggacctacagggcagaaaggtgagtagcgggagccttttggccacgctgggctgtgttagggtggtcagcacggcactgaagtagcccaggccccaccctgtccctggagtctcacagtgggtcctccacatgcaaccttacctcctacgagctcccaccatcaagggtgtggtgaagctttcatggagctgcccggtgagcagatggttgcactgctctttttttttttttttttttttttgaaaatggggtctcgcgctgtcgtccaggctggagtgcagtggcacgatcttggcttactgcagccacagaccttccagcctcaagcgatcctcccacctctcccgagtagctgggactgtaggcatgtgccattatgcctggctaatttttgtattttttgtagagtcagcgtttcatcatgtggcccaggctggtcttgaactcctgggctcatgcgatctgccagtctcagcctcccaaagtgtcggggttacaggcatgagccaccacacctggctgtactgctcttagctcagcctcatctctgctccttcaggtcaggacagagcagctctcttggggttcctaggagcagagcatgtcctttcctctccaccgcactcctgtcttcattccccgtccacggcttcctgctgcagtcaggcttccgggccctgaaactgcttctgccagcaacctcgtcgttactcccacggtctccctgcaggcttcatctgctctacccgcttgtccttgtgacccgggacttctgcctgtgctggggaggtcgctttcccctcaccttcctggctgctccttaccttgcactgctccgtggcactctccccgtgtcccccgcttcccctactgcatcctctctggtaatcacgttccttctcatgtgtgaatcagtgaccatcagagccggccttcactctttactattttggattcaaatctcatgtccagctgccatcctgtcacctttccttgaatatgccacaaactggactcacccaacgcggagctatcatctttcatctttcctgccagtctttttttaaataacagctttattgagatgtagttgacataccacaaaattaatgcatttcaattgtacagttgagtgatttttttaagtaaatatatggagttagccgtcacccagtctcatttagaacatttccaggcccgacatggtggcacatgtctgtaatcccagaacttcggaaggccaaggtgggaggatcgcttggacccaggagttcaagaccaatctgagtaacatagggagaccctgtctctataaaaacaaaaaaaattaaccgagtgtggtggcacgtgcctgtagtcccaggaggctgaggtgggtgaggtgggaggatcgcctgagcccaggagttggaggctgcagggagccgtgcttgtggcagagcactacagcatggctgacagagtgataccttgtctctaaaaaaaatgggaatgaaaagagaacatttctgttacctcccaaattcctgggagcctgttgatagtctgcatccccatgccccaggcctggcagccactggtctggtttgtgtctccagtatgtgcctcttctggcatatctcaaaagtgaggtacgcagtgtgtggtcttgtgagtctggctcctttcgctgagcataatgtctttgagattcacccatttcgttcttttgaaggctgtgtagcattccacggtgtggctatccattcatgtgcttatggacgtttggattgtgtccagtttttggccactttgaataaggcttctgtgaacatggattcactggtcttagagaggatgtatgtcctcagtctcttatgcagatgccttggtgtggattgctgggtcatgtggtagttacgatcgactttttaagaagctgctgaactgttggttgaagtggctgtccttttgacatccccatcggtaacatctgagggtccaggttctcggatcctcaccagcacctggcattggctttttttttttagcataaccatattaatgggagtgtggtgatgtctccacatagttttaatttgtatttgcccaatgactgatgatggtgaacatcatttcgtgtgcttgtcttgcttggtgaaatgtctattcaagccttttgcccatttaaaaaaataacagttttattgagatataattcacataccttacgattcactcagtgatttttgtatattcataaggttgtgtaaccatcaccacatcagtttaagaaccctttcattacccattggcagtcatgcaccatttgtccgcagtcccccagccctgggcacccactcttctcctttctgtctttagcttgcccattctgggcatcttgtgtgaatggaatcagacaagtgtgtggtctttcgtggctggcctctcatgtggcttcatgttttcgggctcatccatgtcgtagcctgaatcaatacctcatttctctttcttgctgaataagattccattgtgtggatagaccatgttatttatctgtttctcagctgatggacatttgggtggctcctacttttgggctgttgtgagtaatgctgctataaatattcatccacaagtcgccttttttctccctcatagatgagggcataggagatgattctgaaagccactgtgtggtgtaccggtagaccggggtcacattgaattggagtggtgggagcgggcgttcttgccatgttcctgatgctgtgtggggaggcgaggaagcactcagggcagccccttctgtctgccagcatttcctgctgcatctccatcatctctgactggccccactttggtgcctgactgcttgggcctgcccagggtcggctacctccttaccctctgccactccttccactcctcccacccctcccaccctgtagtctccgtttcttacccggactctttctgcactctcccaggtcgcctccgtccccagcacctgcaggttcccttccacacttcgtggtcctcagcagcatcttctaaatcacattccttctgattttgaaccctgatgaaaacttctagtgacatccaccacccccactgccgcctccgggatgagtccagcccctcaccctgtcctggctgccttgggctgggctggcttctgtccagctccacaccctcaccttggggggccttgctgtctcccggcctcactcttgcccctgctgcccctccctcggccgttcaggctcctcgctgtgcacgtgttcatttactcacaaatgttcacagaacatctggtcacggcactggcccactgctgggggatgctgggccaccagtccctgctcttgtggtgctcagagcctggggagggagacggagacaagccccggtaagtcctgagataaagcgtccagtgggggttgacaggatgccactctggaagccccgtctggcacgtttatttctgggctccctccatgacccccttccttgcttttttctatcacatggggtcagccccactttgtctgcttccctcttctgctctgctctcctgagcacgggactcatgtctggttgtaatctttacagcctccagggcaggtacagagcaccttgctgccttgcttgtttgttgactgagggagggagggactgatgagggagggagggaatgagtgagtgactgagtgagggagggagagggagggagtgagggagtgacttgagtgactgagtggcctgttgcttccgtgttcctgttaacactcctggaccgagccctactgacacctgggccctgcttctcgcccattcaccaggtctctctcctcctgggcgagccgttcttcactaccagcctgctgccgtggcacaacctctacttctggtacgtgcggaccgctgtggaccagcacctggggccaggtgccatggtgatgccccaggcagcctcgctgcacgctgtggttgtggagttcagggtaggccacccaggggatgttggagaaaaaagcagaggaggcgggtggggaaccttgttttcttgcaggaaccttgggtgcctgtagagcggctcaggccttgatgatttgagcttgtgttttctttctgtgtcagcacactgtggggttgaatagaagatgcttgccttttaaaaaatgcgataatttgacatacgaaatggaaatggctgagtgttgtcattttacaattgtggcttatcagaataatttaaaaatataaattaagcgtttcagaagccatgccgtgtggcctgctctgctctcattaatagccgaggcttcgattgttaaaggcattttgagatgggagagtcagctgctttgtgcaagaaaaaatggaaaagcttccttttaattttctcatcaaagcagaaccatagtcacaaagtcattttgggaagggcatttttattaaaaggatttgaaaagctttaccctggatggagagtgtatctcatttgatgagagtggttttctctcctagcttagtggctccatcactgaaagtctgggcatttctcctgtgttacttgtttacctaatcagatttccacatgaattctggttttcatggccaaagaggggatgtcacgatccatgcgtgcgtgtgaccaggaggaagggagggaaggctgtgtggcctgagtgtcctctgggttcctcttggcagggcctttttctctccccagcatcctcatgaactggagatgatgctggggagagaattggcttacagatttcttcccaaagaaatgatgttcaggatggcccggataggagtgtgcagcccccagcctaggagctctggccgactgtcccttataggagaggactcaggtgtcacgtcagagcttgcaggttcccgcccagcccagtctgttacagaaaccgttgtggatctttgttctctctgagccccttcatacttgggggtctctttcaggtgtgcagggaacagcaagatgtgcctcttgttcttgctgccacgcttccctgtgtcctggcgggcgggtgtggacggggctgctccttcctcacaggacctgtggcggatccggagcccctgtggtgactgcgaaggcttcgacgtgcacatcatggacgacatgattaaggtaggcagggccacactctgcatagtacccccgacctgctcctgtatcgcaggcctctcacagggtcccagcttgggcagcacaggctcttctgttgggggcagtgaggtcaggtgctgccattttgtgtggttcaacatgagcattgcttggtaccagccctgttcttggctccgtgctgtcaccctgtgtcagaatctccactgggcctgcacgtcctgtcattgcaactgcccctgccagtgcccacagcttcttttctagtggggctgactttccagaggccatctgggaaccttcttaggcagccatttccatggtgggggctccattcccgggaggggtacctgaggagattcccacaggttatttacatggtaggggttagcaactgggcctacgttctccagaaccatgggctgtcctgacagcgccagtggtccttggattcatgaggactgaagctgagagtcgtgttccatccacatgagaggggcagggtgaggagcatgggccgtgctgtgtattaaggaaatgcacgtggctcctgcttgtcatcccagcactctgggaacctgaggctggtggattgcttgagcccagacgtttgagaccagcttgggcaatatagcaagaccctgtctcgacaaaaaataacaaaaaattagccaggcatggtagtgcacacctgtattcccagctactcaggaggctgaggtgggaggatggctttagcctgggaggtcgaggctgcagtgagctgcgtttgtgccactgcctccaggctgggtgacagagcaagaccttgtctcaaaaaaagaaatctcatggacaccagaggagcgggaagcagcggtggccccgcagcagcagctatgcatcgggaggtggggcttttctgcttctgctcacctttctgctctcattttcccatagtgaacatggattgcctgtgtgtgaacacttttttaagtaaattaaaccttgtggatattttcagtttgtatcttatctgcccctcacagcagaccattgactgttcgatgcttttagaaatctccttcgtgctgagccctgcgtgctctggacccatgcgctctacgcctcctctgggcccctgctcatggcctgcccaccctggctgtccctgtcccctcttgctgatacggttctgctactctggtcctgggccagtgtctgtctctcgtgtgctaaggcagatggccgagagtggtgggtatcccacagtggggtgccaggcatttttacttctatgctttccaaatccacctgcccttccccacccttagcctggcccttccagtgccctgtcttagacctggcgccacttcacacgaccagccaggcccagggccccgggcatcctccctggcaagtcctcccatcccctgccattggtcttcgtgctcctggtgagcctccgacccaggctgtcccctgactgctgccgtcctggtttgagcccctcctgctctggccgtcctccacacggagcccacatgaacttgtagatctgagtctggccacatccccactgcaggaatgccctagctggctccccacaccacacctgcagagtggcccggctggcctgggtgccctggcctgctctcctgacttagctctatcctcaaggccccctctggcccttctcctgccggctcccatttgaccgtcacctcccctcctccaggtagctttctgcatccctcctggatgcaggtgcccccagcctgccgccaggcaccggggctgtactgtcacgcatttatccctccctgtggcccggggcccacctgtcggggccacacagctgtggtggtcaccaagtttctaggtgctgggtgttctcaccagtgatgtagatatgtggtcctcagaaggcttgagacaggcagcaccaccccatcttaaaaatccggagagcgaggctcagagccagcggtgcctggggagccactgatgagagagaagtggcagagagggggcgccgctggtctgctgggcgctcggcatctttatgggagaacgcacaccccttgtgactgcagtcagtgggagccaagccggggagcggtacctctgtctagctgccggcctgtctctgcagcccccaggcccccttctgttcgcagcgtgccctggacttcagggagagcagggaagctgagccccacccgctgtgggagtacccatgccgcagcctctccgagccctggcagatcctgacctttgacttccagcagccggtgcccctgcagcccctgtgtgccgagggcaccgtggagctcagaaggtgggtgcagagagggctggggggcagggaggggctgctgcttgcccttggagttctcacccccgtggtgagcacagctggcctgggagacgctgacacgtggagggggtattcgtcctccccacaaccttgcccttccctgtcagagtggccctgcgcgtgtggtggttcccacggtcctgtgtgtgccactggtggaggagccaggaagggctctgctccccctctacagctgaggctcccttgttggatcacagctcaggaagatgggagcttacttcctgtggtcaccgatgcaccattttcctgaaccctcctgggagctgaagcaggtcagggtcagcaagtgctgcttgcgtccagggacgggcagccctgtcctgctccggccctcaccccaccctcgcccgaggagtgacttctcctggaagcacctcccaactcggggcaggcagccaggcagggcgggcgccatcacctgagctcccagggttgctgtctggggcatcagaggggccttccggccttcagtgccaggctgtgcctcaagctcccccagaccctgcagccacaccggccctgccccatgtgtggcccggctgcagggctcgggttggctcaggtgggggcttggctgcggctcttctggctggggtttttctgaggaacgtttatgtaactgcagcactaggaactcccggcagggcaggaaggaagtggggaagaccacaggtttctggaaagccgcaggagctgcagctgttcccccgctgcctcttgtgtgactacttctgctgggcccccctctccttgacaggcccgggcagagccacgcagcggtgctatggatggagtaccacctgaccccggagtgcacgctcagcactggcctcctggagcctgcagaccccgaggtagtgcctgcgcaccgggcccagtgtgcgtgcagaccctgagagcaggcgccgcctggggaggcctccctgcccccatgctctgggtgtttctgtcacaagttcttcgggccagatgatgacccctcagtggtcctgggccatctggcccctgagcagcttctctctgctgcgagctgcctgggctggaggctggctaggaaggaggctcaggtgccagggagccctcaccatcttcctgctcttcttcctacaggggggctgctgctggaacccccactgcaagcaggccgtctacttcttcagccctgccccagatcccagagcactgctgggtggcccacggactgtcagctatgcagtggagtttcaccccgacacaggcgacatcatcatggagttcaggcatgcagataccccagactgaccactcttgagcaataaagtggcctgagggctggggttctgagtggctcatggctttctagcggggaaggctgaaggccctcctctcctctctgggagctgctcggcctcagggatgggaaagactgcgccgtgttgcatcttgttgcatctttgcactgctggcctctggctccagctgtggcaggaagcatgagagggtgactgaatttggagccctggaggggctgggaagacccccctgcttgtgcttctgaggtgctgagaatgctccaacacagagacatctctccccagctgggaagggagtggaagcacagggagcttgtggggctggccggtggggttgtccacgccgcccttggcgagcagtccccgtggcgggagcctgtcctgtctgtctcactctcgaggatctccgggtccctgctcttctggcttctgctaggagggtggagatgctgagttgtggctgggtctctggggcttgaagaccctggctgggcccgggctgagaggcctgggttctggccctttcacctgacaggtaacttcaagccacatccataggtgtctggcctcagtgctgcaccagctggtggcctgccaggacctgagactggacacaaggcagctgtcccagagcagttcctgagatgcaggcccaggaaagtggctgtcaggggagctgggaggcagccctgttccctgcacctccctcagattggaaagcccctcctgcaggtggggtatggcagggagcagcccctgcccagcgccgcttcaccaggaaggtcagtaggtgccgtggccttgcttctctcacacactaacccccctttggttatgtcccagctctcagaggtaacagcagacaccacgtgagagaacccagtggcctctggctcgcagcttagaaggtgaggcttgtgccaggccagccgagccgcctgtatgagcagagttccggtgtcctcggattcagggcagacttgggcagtgcctgtcctgcagttgggggcaggaactccctcccctgcccccaggcgtgcccctgaggcctggccccagcttgtcgctgaaataagtggagaacaccagccttgagcctcacagttttattttctcctcgttatccatccttcctttcagcaccagtaaggaaaaagaacacctctcttcgcaaaatattttatcaggtgtaaagacttgtttttcttctagggaagaaccgtctggatatatatttgataatgtttttaccaaaaccataggtgtgcttaccatagaaaacccctaatgtcccatgaagatacaatacagaaaaaaatacagaaattaaaaaagtttttataacagtatttctaaatctcagcaagttaaaaagcaatagttaaaaagcatcaagattaatatacttaaaacttaaggtggttttggacaaatgaaaatgaacatttccttcctcagtggcccccgcgccttgtggcttcctttgagactgggcctagggcaggaacagagtcttggtatgggcctcgggtgacccgtgtgcccacccctgctaggccttagatgccacagaatctgagatccagcaatggttcactttaaaaaatcagtggaagggcctggcctgcacacaaggcccgggagtccataggcagccacaatgagacacgtgggtgggggggtcccggtcttggtgctgagggaggtgtgcgggggcctgggggccgcacatccttactctggaccccaggacctgactaggcagaggcgaccttgtgatgacagaaaatgacttgcctaaggccgcctgtgaggtgggaggggaggagcatgcagccctgactcccacgcctgctgccccgggagggggtgcctgggtggggaagctatgttggggtctggtgtgggggccctgcccgggcctcaactgctctccctgtgcaggcagtcggcaggcggctcggggtctaggggtccagggccggccggcccagtcgcttgtgtgagcagagtaccagctgcttctggaagttgggggcctccacatcatgaatcccagtcaaggctcacaggccagccccttggaggggtgggccgggcagagagcccagcaggatgctcgccctcagcagccccttcctggctctggactctggaggggcagggcttgggcccgggcagacggtgcttcccaggccaggtgagttcagacaggccagtgtcacaaggacgcacgtcctagcgccaggctccctgggctctgcagcgttgtctgccccagcacagggccaggcatctggctggctgcgtggccccctcttggtccctcttgcagctcaatgggtgacaaggcacagcatcagggcaccagcaccaggaggggctgacagcagacagcaggtcctggtgctccctccagcctcaccaggcaaagccggccctgggccaggctgggtgtagggccagggcgccacgaggagcggaggtcagcggggattgtcaaaaacagtccctcaagttgagtctcgaactttgaaacagacaaaaccttcgctgcatgacaggagcagccctggagtctcttaaaggcaggtgggcagaggcagtgctgccgaaggggcctgggggctgtaggcatcttggggctggaggcagatcggggaccacaagctgttggccagctctgccatgctgaacttgggtgccagtaccacaccctgccctgggcatgcagcaactgtcagccttgctgccccagcttgcgcactggtgagggccaggctgctctctgcaccttggcttcctgcctcctaggccggggtccccttgtggccttggtgttggctggggtagctgttgaggatgggcctgggaggccagagccgcagccccacccggggggcaggcaggggttcctgagctcagccggcacgcaggtggggcacgtccccagggagggattggtcccgaaccagagaggtgtcccgtgggggagaggattggcagaaagaagaggatgtgttggttttgatagaagagaagctacaaatagattattttcaaaatcaggatcccccccacccccgtttatgctgtgagtcccttcttcctgtaaaaaaaaaagtggatactctcttctcggatccccgtttatggctccactgcccagatgggaggctcccggaggaggcccagggtgccagagcctgccagactctgttgtgcctgagctggggaagggaccctgtctcgggaagagcaaagttctatgagtgacttacagaccctgtgaagtgagggttggttttgtgattaacctttttctgtttttctttttaaaatgtaattgcccttgaatgcgagaccctgggaagagccctgggctggctggtagagatgcagccctcggaccctgcaggagccggcccacactggaggcgggagagctggtggccgtgcccaggaagtgcttctttggctggttctgattgtgtttggagtttggccttgggtgaggcccgagcaaggggtctgtggctacagcgtggcacgtggcatgcgggcagcgtgcatgcgagggtgcaggcatgcgagacgacattggcagcagacaaaaataaagaaccctggacgaagcttaagaggagatacagagagtacacgaacccggtcctcatactaacccacgggttacaaactcggttgtgctgtagatttgtagaaaatcgtgttgtgaaagaatggcactggttaggcagctggaggctgcctggggcgggcctgactcctctgtccacagtgaggcccagaggcgcagagcagcgcagcttgccaggttcccgggcactgactgtggctccctgccctgtccctgccctcctgcccccaagcaccgggcactcgatggaggggacatggcccagggatgggctgcagctgcaagggctggcagaggccccgctgctgccggacggtctatgcctcctcctcccccgaagacaccatcagtcgcatggctactggcaggtggtccgtcaggccggacagctgggtgataaaactgaattcttccacctcctggggtgagtgggagaggggagaaacagcctggtcagattccaagggcatcttgcagggagcggcctggggatccccaaagtgaggccccggggctggggtgggctgggaccttcctgcagtcagagggatggggcctggaggacctggggccctaagggtctgagggagtgatgggtatcattgtaagagtggcctggggcgtggggtttcagggagcggctgtcgagagctgcagggcccgggccctgctctctctttgcatggccctggctgctgggccctcctgactcacggccttccagtctgggcacagcccctcctctgcatgcagcatgtagtcgatgcgccggccgttgcccttcagcagctccttccgccccttctggcccgagctcttgctggtgggaaacgcca

SEQ ID NO: 12872 - DNA, 22400 bp, Homo sapiens
aggaaaattgtgaggccgtgccccacagagccaccgtctatgcacagctggtggagtccgggaggatgtggtcgtggaacaagctatttcccatccacgtgcagaccagcctcggagagcaggtcatcgtccctcccgttgacgtggagagctgccctggcgcaccctctgtctgtgacattcagctgaaccaggtgtcaccagccgactttacagtcctcagcgatgtgctgcccatgttcaggtaccaaggagccaccataggtgatggcgctttgagacatttgatggaagttgggtattaggaggttctttttgagtgggaaggaaatctagctgctgtcacctgcctcgaaggcaagagtcctttgcagccaaatgtcattgccagtgaagtcactgtaaaagcttaaaaaatggagtgtgtgaggttaaactctgcttacattcttgaatattattcctcagcatagacttcagcaagcaagtcagtagctcagcagcctgccatagcaggcggtttgaacctctgacatctggccgagctcaggtggttctctcgtggtgggacattgaaatggaccctgaggggaagatcaagtgcaccatggcccccttctgggcacactcagacccagaggagatgcaggtaagaggcaggagcctagcatgtgccctgtcaggaaacttgtccactgctgttcatgggaaagtaacagttgagccttggacccaggagaatttagagacaggagggctgtgtcagaatcaaagacaaaagtttttaaaaagcaagcaaaggctagctgtagtaacgtagccttcccagggtgagctcatggtgagcactcatggacacagtgaggaacagagaagttggctttcctctcccgcctcatcatgatgcagccacccttagataccacccctcatcccctgagtaatcccagggggctcccatcagcttggaatagagaactacagcctcaccttctgtggcctcaaaatctcctttctccaccccgatagaaagtaggcagaggacatgaaacacagaaaaggaaatacagatgatggggatagttgcccactgtccctcataataagagaaatgcagttttagctgctcacagcacctatgctcccagcctctcaggagactgaggcaggagggttgcttgaacccaggaagttgaggctgcagtgagtcgggactgcattactgcactcccgcctgggcaataagatgagaacctgtctctaaaaaaaaaaaaaaagagaaatgcaactttaaactgcaatgagatctcattttcacctactagtgaataaagtttaaacagtttgcaagcacactgttggggaagctcagggaaaaagcaggaaagcgagtcatcagaacgtttcaggtagaaagcaatgctgctttcagacatggggctgtggctggatttgcgtctgtgcagaatagatgtgtgcagccctggtttagtagaaaaaggccaacctaaaggccactagcagggatcaagtccattatcctttcagtgggtgaggtagctctctgtgcactgatgtgggacaagcttcagggtggattattacctgacacaaaaataaaggtgcagaatggtgtgttgtgtggcagcactggtgttagtaaaaataggaatatatgtgtttgtgagtggatagtcatgtgtggtgtacatataaggaggtctttggaagaattcccagaaattcgtaaaactgactgcatctgggaatggggactggaggttaggggtggaaaggaaacatattttttactatgcgtccttgtataccttttgaattttctctcatgtgcttgtgttatttacacccccatccaccctctctcactctcacactcaaaggaaaagaaagtgggaaaggtgtgtcggaattgcctgatgggttcttcccacccactgttcagacaaaaccaattcgctgacaccatggcattgcaataaagactttaattgacacgaagccagccacaccacgtgggggagagatttgttactcaaatcagtctccctgaaaattcacaggctacggttttttgtttgtttgttttgagatggagtttcgttcttgttggtcaggctggagtgcaatggcgcgatctcagctcactgcaacctctacctcccgggttcaagcaattctcctgcctcagccccctgagtagctgggattacgggcatgcgccaccatgcctggctaattttgtatttttagtagagatggggtttctccacgttggccaggctggtctcaaattcccgacctcaggtgacctgccccaccggcctcccaaagtgctgggattacaggcgtgagccgctatgcccggctcaggctagggtttttcaaggatagtttggcaggcgagggagtccacttctgggtggagtcatcagacagaaacgtaaaaacccgaaaagacatttcaaagggtcaatcttagtttctgcaaggtggtgttatctgcaggaggaatcagggaaggttgcagatcttgtgacctaacaatggcttcaccttagcagaattcagcctcctctcatcctcctaacctgatgatctttcattcagtttaagtttaattttggggaaggacggttatcatttaaagtattaaccagctgggtgtggtggctcacgcctgtaatcccaacactttgggagccccaggtgggtggatcatttgaggtcaggagttcgagaccagcctggccaacatggagaaaccccacttctactaaaaatacaaaaattacccggatgtggtggtgcgtgcctgtaattccagctactcgggaggctgaggcaggagaattgcttgaacccaggaggtggaaattgaagtgagctgaggtcacaccactgcactcaaacctgggtggcagagcgagactctgtctcaaaaaataataagaacaaaaaataaactgttaaccaaatgtctcccaaagttagcttggcccggacccaggaatgattaagggcagtttggacattaaagcaaaatgggggttggttagatgagatctctttcactgtcataattttctcactttttcgcaaaggcagttttggtttcaggaccaagaaatagaacctgtctctacccaggagcgcctcaggcaccatcctttgtccatggtccagcctgcctggccttaacccctggctttgtgttgaatgctcacctgctggttctaggtgtccacaacattatggaaggccttagcagcttcacctaccccattcccagagttactgtttaggccgaagggttgtgactgctggggaattgctgtcaatcagcgtacccataccgacagcagcatgtgagactaagaagtatgtgagcttcctagtctcccctccaccttccaggtgcctggccccgggtgtgtgtgtgtccagccagggcctgccagcatccctctgcaggctgtgtgtgtgtcactctgaattcacccacagagttgagattggcaccgcgtcacattcttcctaagactgtgttgcagaattagcataagaatagcattaaaatgttagtacttttggccggtggctcactcctataatcccagcacttgggaggccaaggcaggtggatcacctgaggtcaggagttcaagaccagcctggctaacatgttgaaaccctgtctctactaaaaatacaaagaaaattagccgggcatggtggcaggcgcctgtaatcccagctacagggctgaggcaggagaatcacttcaacctgggaggtggaggttgcagtaagctgagactgcaccattgccctccagcctgggcaacaagagcgaaactccgtctcaaaaaaaaaaaaagttagtacttttaatttgcatatcttcggagcgctactatgtattttttctccttgaatcctcttagtagacaaacaaggtaaccacaaccatagccaacccgggactcagcaggctccagggattggagcggggccttgtgtccaggagcagtagagtgggtcctgcccctggtctcttgactgtgggtcttgtgttgtttctctaccagcgttgacttttggattggaaatttgaaagctgctaatgaatctccctcatgaattcatgtaactgctttgatcctaagtatatttagtctgtcccaccttggcacagtgggttctgtcaccagctcctcaacgttaggacccaggaggtccctgtggtaggtagtatgggaaggacatgatgacagggcagtgccatgggagcctaggaggggtcgggaaagggttctcctgtcttcttcacatgcatttgcatagtgtgggaatgaataaaaggtttaaaagaacctgtgttattcctgttactatttatttttccagaacatatctggtcagattttcattttctagtttttatgttcaagtaagcgtcttaagcgtgtgggaatgtcattctcctgcctttttgttaaattaaagaccaggtgggtgggcacattccttacctgtgctcttggagtcccacagggccaagtttttcttagttcctgaaggtgacagaatgagcaggcagtcgtctcatcagagttgagccaggcatctcctgtttttgtttgttagagacagggtcttgctttattgctcaggttggattgtggtggcacctcttagctcactgcaactgtgaactcctgggcacaagcgatcctcccacctcagcctcctgagtagctgggactacaggcacttgccactatgcatggctaatcttgtgttttttgtagaaatgggtgtcactggtatgttacccaggctggtcccgtacacctggcctcaaacgatttgccagcctcggcctcccaaattgttgggattacaggcatgagccaccgtgtccagctggcatctactttttagggcagttcttcctttttcaaaaagaggcttaacaattatgagcgaaataaacctcattatataaaataaaaatatcactcatggtcctccctttcactcaaaatagctccctttgtttggtctctctccaaacgcgtgggtgtcatcggtgctcatctctgttccgggccccgtggccttcagcagcagcgtttaagatgtctgtccgtattctgcacgagggtttatatcccgttctgagtgctggccatttgggtgggttccagtttttgctggtataaataattctgtgatttgcatttttatgtgaatataacttttttttttcttttggggttttcttaggatagaaacctgtatgtggggtttgtagtaaggactagcacagcttattaaaaattgaccgtggatcattgtcaaccatgtttcacaatttagaatattcagttatttaaatacttcaatttaattcaaagaataagccaaaacctttttgtattttcccacctttttattttgaaaaattatatatccacagaataagtgaaaatgaacactgatggtcgctttattaatttaaatttaccagttgttaacgtttgccacatctgctttatctttgtctttctgcctcccttcctgcatctctacacacacacacacacacacacacgggcatgcacattttttttttttattgctaaatcatttgaaagtaagttgcagacatctgacactttacttttaaatacttcaacacttatctcccaagaatgaaaacagtctgcaacataaatgaaacacatgatcacacctaagaaaaacagtggttccatagtatcgtctaacatatggttcaaaataaaatttgtctccagaagtccttgatagcttttgtttcctcagtctacgatccagttaggtttagtgcattgagtctgactgttttgtaaattccgagtacgttaaagcctttggaatgcgtgccatggactgttctgaaaaggttccccttaaaccactaggtttaaaccaatttttttccttcaaaggaaacattcagcacagctctacgtgttgaagagagagctttggtgctactctgatggggtggggactggagcctgcacttgtcccctcccctgagccactctggcagattgctgctcttggccacattgtgtcttcctaaagccagcagggttcccgcaaacttttgggccactggcctctgagtttagagtttatttatctccttggccacaatagccagctgtagtctacattgtggacgtcctgaaaactggcagttctctggcatttggctcctggattagaagcattgctcatactgcagctcgttgacagctgactctgttctccgtttcagtggcgggaccactggatgcagtgtgtgtacttcctgccacaagaggagcctgtggtgcagggctcagcgctctatctggtagcccaccacgatgactactgcgtatggtacagcctgcagaggaccaggtacgtcgagcctcgtgggggtggaggatgagcctctgagacttgtatgtaaattccccatttacagatcctctggaggtgccagtgggttgatttgtgtctggacagaataacataagaacaaagatttgtgaccagtgtgtcagtgcccattcgtgtgtacccaggagaggctgtcatgggttgctggaatctgtttagagcagatgcgtaggaaaagtctggaattagcgggtgctctaagccctcatgcctactggagaccagtgtccagattcatgccctctggagacctgtggaggcgctcacagcccacgtctgtttgttcatctcctggcctagccctgaaaagaatgagagagtccgccagatgcgccccgtgtgtgactgccaggctcacctgctctggaaccggcctcggtttggagagatcaatgaccaggacagaactgatcgatacgtccaggctctgaggaccgtaagtgtccagccccttggcttgttgtggggaaaagggagaaagaagtttgtcccatgaaccccagcactttgcttatgatttgctgtttctttcctgtgtcctcttgtctatgagtggcttcagcgagcgcctcctgggtgggcactggagcagaaagcgggagagcctggggctggacttcctgagggcttgctctctgctctactgggagagcctctggctgggctcctgctggacacctttgccttgtcagacacagtcattgctgtgggtggtcacggtggattaggccaccccctcttttcatgtgttgtcacctttctaaaattttctaagatgtaaatctgatcatgtcgctctcctgcctgaaaacctttgctccctgctacctgtagcaggggactcggcttggggattacagatggggcttagagggagggtctcttgaggcccttgggggtgtgtacagaaataggtgtgaatgtgtgcattttgggggatggggggaggatccaagccatcctgagtttctctcagaggggtctgtcacccagaaaggcatccttgcctttgggcagtcaattgtgaacactcaagccttggaggctctcagctgtctgtgctctaaccagacagggaagaagcctgttgtcatggactggaaggtggcctgcaggtggtgcaggccttcagcggggcctctaggctgggttgaggggtgtctttcctgacactggggacaggtggggagatgtgagcaaggcgggcatgtttgtggctgggggtggttactgcatgaggacgcagggggatggtctgaggtctgggcaagtggagtgagaagggaagtatttctgacagcttgccagcaggaatcttctggcaaactggaggaagccctgtgctgagcttgcctgttccccgcaggtgctgaagccagacagcgtgtgcctgtgtgtcagcgatggcagcctgctctccgtgctggcccatcacctgggggtggagcaggtactgacatgcacccttgtcagcctcctgatgtgggcttgtgagttagagcattgcgtggtccgggtgcacaattctgtgatcaaggctctttgcaaaggccactgttgtgggcacagcatgctcgggtcaggggctggggggtttattgcctgtgcgtgcaggcaggcgtcaggcctcagagctggtgttcaggctgccccagggagggaatgagggcagggagggttgttcaggtgtgtcctctgtcttaggatggtcttgtcgcattttaatctttaatttcttctctgttaagtgaatatcttacaactaatagcgtggtgttccctctaggtgtttacagtcgagagttcagcagcttctcacaaactgttgagaaaagtaagtgagaattgttgttgctgaaatagtgagaggacctgtggggtctgggttgatggctttgaagtggcattggccccaggggaacaaaggagtggtggctcgcttgcacccctgtgttgtcttggttgctgcctggagagcagccagaggccttgggagctgtcactgaaatagaggcaggcatttgcactctgctttgtttttttgtgtctgaagaagtttaggcttttttcctcacttcacataagctactgttgcggtagaattaaatgtaggatgtgtttctgggacatcagtgctgagggagccagtgctcacagcctgatgggagatggcatttctctccctggccagtaactggtttgatttcctctccaaaggggaactcccttcaccagaactgcaggctcgcactgagtcctggtgtgcacatgcgggagaaatttcttttgcttttatcacattgtgctcctgatctcatccgtggtctataggatgccccccaaggagaggatttttccacaaagcagataaaagtggtgttccagaaccatttgccggaaaattcaaagcggagaatgcaactttgagagatttttttttcctgacaaacacaatactttagtatgaatacagtaattttacggttttctttctaagatcttcaaggctaaccacttggaagataaaattaacatcatagagaaacggccggaattattaacaaatgaggacctacagggcagaaaggtgagtagcgggagccttttggccacgctgggctgtgttagggtggtcagcacggcactgaagtagcccaggccccaccctgtccctggagtctcacagtgggtcctccacatgcaaccttacctcctacgagctcccaccatcaagggtgtggtgaagctttcatggagctgcccggtgagcagatggttgcactgctctttttttttttttttttttttttgaaaatggggtctcgcgctgtcgtccaggctggagtgcagtggcacgatcttggcttactgcagcctcgaccttccagcctcaagcgatcctcccacctctcccgagtagctgggactgtaggcatgtgccattatgcctggctaatttttgtattttttgtagagtcagcgtttcatcatgtggcccaggctggtcttgaactcctgggctcatgcgatctgccagtctcagcctcccaaagtgtcggggttacaggcatgagccaccacacctggctgtactgctcttagctcagcctcatctctgctccttcaggtcaggacagagcagctctcttggggttcctaggagcagagcatgtcctttcctctccaccgcactcctgtcttcattccccgtccacggcttcctgctgcagtcaggcttccgggccctgaaactgcttctgccagcaacctcgtcgttactcccacggtctccctgcaggcttcatctgctctacccgcttgtccttgtgacccgggacttctgcctgtgctggggaggtcgctttcccctcaccttcctggctgctccttaccttgcactgctccgtggcactctccccgtgtcccccgcttcccctactgcatcctctctggtaatcacgttccttctcatgtgtgaatcagtgaccatcagagccggccttcactctttactattttggattcaaatctcatgtccagctgccatcctgtcacctttccttgaatatgccacaaactggactcacccaacgcggagctatcatctttcatctttcctgccagtctttttttaaataacagctttattgagatgtagttgacataccacaaaattaatgcatttcaattgtacagttgagtgatttttttaagtaaatatatggagttagccgtcacccagtctcatttagaacatttccaggcccgacatggtggcacatgtctgtaatcccagaacttcggaaggccaaggtgggaggatcgcttggacccaggagttcaagaccaatctgagtacatagggagaccctgtctctataaaaacaaaaaaaattaaccgagtgtggtggcacgtgcctgtagtcccaggaggctgaggtgggtgaggtgggaggatcgcctgagcccaggagttggaggctgcagggagccgtgcttgtggcagagcactacagcatggctgacagagtgataccttgtctctaaaaaaaatgggaatgaaaagagaacatttctgttacctcccaaattcctgggagcctgttgatagtctgcatccccatgccccaggcctggcagccactggtctggtttgtgtctccagtatgtgcctcttctggcatatctcaaaagtgaggtacgcagtgtgtggtcttgtgagtctggctcctttcgctgagcataatgtctttgagattcacccatttcgttcttttgaaggctgtgtagcattccacggtgtggctatccattcatgtgcttatggacgtttggattgtgtccagtttttggccactttgaataaggcttctgtgaacatggattcactggtcttagagaggatgtatgtcctcagtctcttatgcagatgccttggtgtggattgctgggtcatgtggtagttacgatcgactttttaagaagctgctgaactgttggttgaagtggctgtccttttgacatccccatcggtaacatctgagggtccaggttctcggatcctcaccagcacctggcattggctttttttttttagcataaccatattaatgggagtgtggtgatgtctccacatagttttaatttgtatttgcccaatgactgatgatggtgaacatcatttcgtgtgcttgtcttgcttggtgaaatgtctattcaagccttttgcccatttaaaaaaataacagttttattgagatataattcacataccttacgattcactcagtgatttttgtatattcataaggttgtgtaaccatcaccacatcagtttaagaaccctttcattacccattggcagtcatgcaccatttgtccgcagtcccccagccctgggcacccactcttctcctttctgtctttagcttgcccattctgggcatcttgtgtgaatggaatcagacaagtgtgtggtctttcgtggctggcctctcatgtggcttcatgttttcgggctcatccatgtcgtagcctgaatcaatacctcatttctctttcttgctgaataagattccattgtgtggatagaccatgttatttatctgtttctcagctgatggacatttgggtggctcctacttttgggctgttgtgagtaatgctgctataaatattcatccacaagtcgccttttttctccctcatagatgagggcataggagatgattctgaaagccactgtgtggtgtaccggtagaccggggtcacattgaattggagtggtgggagcgggcgttcttgccatgttcctgatgctgtgtggggaggcgaggaagcactcagggcagccccttctgtctgccagcatttcctgctgcatctccatcatctctgactggccccactttggtgcctgactgcttgggcctgcccagggtcggctacctccttaccctctgccactccttccactcctcccacccctcccaccctgtagtctccgtttcttacccggactctttctgcactctcccaggtcgcctccgtccccagcacctgcaggttcccttccacacttcgtggtcctcagcagcatcttctaaatcacattccttctgattttgaaccctgatgaaaacttctagtgacatccaccacccccactgccgcctccgggatgagtccagcccctcaccctgtcctggctgccttgggctgggctggcttctgtccagctccacaccctcaccttggggggccttgctgtctcccggcctcactcttgcccctgctgcccctccctcggccgttcaggctcctcgctgtgcacgtgttcatttactcacaaatgttcacagaacatctggtcacggcactggcccactgctgggggatgctgggccaccagtccctgctcttgtggtgctcagagcctggggagggagacggagacaagccccggtaagtcctgagataaagcgtccagtgggggttgacaggatgccactctggaagccccgtctggcacgtttatttctgggctccctccatgacccccttccttgcttttttctatcacatggggtcagccccactttgtctgcttccctcttctgctctgctctcctgagcacgggactcatgtctggttgtaatctttacagcctccagggcaggtacagagcaccttgctgccttgcttgtttgttgactgagggagggagggactgatgagggagggagggaatgagtgagtgactgagtgagggagggagagggagggagtgagggagtgacttgagtgactgagtggcctgttgcttccgtgttcctgttaacactcctggaccgagccctactgacacctgggccctgcttctcgcccattcaccaggtctctctcctcctgggcgagccgttcttcactaccagcctgctgccgtggcacaacctctacttctggtacgtgcggaccgctgtggaccagcacctggggccaggtgccatggtgatgccccaggcagcctcgctgcacgctgtggttgtggagttcagggtaggccacccaggggatgttggagaaaaaagcagaggaggcgggtggggaaccttgttttcttgcaggaaccttgggtgcctgtagagcggctcaggccttgatgatttgagcttgtgttttctttctgtgtcagcacactgtggggttgaatagaagatgcttgccttttaaaaaatgcgataatttgacatacgaaatggaaatggctgagtgttgtcattttacaattgtggcttatcagaataatttaaaaatataaattaagcgtttcagaagccatgccgtgtggcctgctctgctctcattaatagccgaggcttcgattgttaaaggcattttgagatgggagagtcagctgctttgtgcaagaaaaaatggaaaagcttccttttaattttctcatcaaagcagaaccatagtcacaaagtcattttgggaagggcatttttattaaaaggatttgaaaagctttaccctggatggagagtgtatctcatttgatgagagtggttttctctcctagcttagtggctccatcactgaaagtctgggcatttctcctgtgttacttgtttacctaatcagatttccacatgaattctggttttcatggccaaagaggggatgtcacgatccatgcgtgcgtgtgaccaggaggaagggagggaaggctgtgtggcctgagtgtcctctgggttcctcttggcagggcctttttctctccccagcatcctcatgaactggagatgatgctggggagagaattggcttacagatttcttcccaaagaaatgatgttcaggatggcccggataggagtgtgcagcccccagcctaggagctctggccgactgtcccttataggagaggactcaggtgtcacgtcagagcttgcaggttcccgcccagcccagtctgttacagaaaccgttgtggatctttgttctctctgagccccttcatacttgggggtctctttcaggtgtgcagggaacagcaagatgtgcctcttgttcttgctgccacgcttccctgtgtcctggcgggcgggtgtggacggggctgctccttcctcacaggacctgtggcggatccggagcccctgtggtgactgcgaaggcttcgacgtgcacatcatggacgacatgattaaggtaggcagggccacactctgcatagtacccccgacctgctcctgtatcgcaggcctctcacagggtcccagcttgggcagcacaggctcttctgttgggggcagtgaggtcaggtgctgccattttgtgtggttcaacatgagcattgcttggtaccagccctgttcttggctccgtgctgtcaccctgtgtcagaatctccactgggcctgcacgtcctgtcattgcaactgcccctgccagtgcccacagcttcttttctagtggggctgactttccagaggccatctgggaaccttcttaggcagccatttccatggtgggggctccattcccgggaggggtacctgaggagattcccacaggttatttacatggtaggggttagcaactgggcctacgttctccagaaccatgggctgtcctgacagcgccagtggtccttggattcatgaggactgaagctgagagtcgtgttccatccacatgagaggggcagggtgaggagcatgggccgtgctgtgtattaaggaaatgcacgtggctcctgcttgtcatcccagcactctgggaacctgaggctggtggattgcttgagcccagacgtttgagaccagcttgggcaatatagcaagaccctgtctcgacaaaaaataacaaaaaattagccaggcatggtagtgcacacctgtattcccagctactcaggaggctgaggtgggaggatggctttagcctgggaggtcgaggctgcagtgagctgcgtttgtgccactgcctccaggctgggtgacagagcaagaccttgtctcaaaaaaagaaatctcatggacaccagaggagcgggaagcagcggtggccccgcagcagcagctatgcatcgggaggtggggcttttctgcttctgctcacctttctgctctcattttcccatagtgaacatggattgcctgtgtgtgaacacttttttaagtaaattaaaccttgtggatattttcagtttgtatcttatctgcccctcacagcagaccattgactgttcgatgcttttagaaatctccttcgtgctgagccctgcgtgctctggacccatgcgctctacgcctcctctgggcccctgctcatggcctgcccaccctggctgtccctgtcccctcttgctgatacggttctgctactctggtcctgggccagtgtctgtctctcgtgtgctaaggcagatggccgagagtggtgggtatcccacagtggggtgccaggcatttttacttctatgctttccaaatccacctgcccttccccacccttagcctggcccttccagtgccctgtcttagacctggcgccacttcacacgaccagccaggcccagggccccgggcatcctccctggcaagtcctcccatcccctgccattggtcttcgtgctcctggtgagcctccgacccaggctgtcccctgactgctgccgtcctggtttgagcccctcctgctctggccgtcctccacacggagcccacatgaacttgtagatctgagtctggccacatccccactgcaggaatgccctagctggctccccacaccacacctgcagagtggcccggctggcctgggtgccctggcctgctctcctgacttagctctatcctcaaggccccctctggcccttctcctgccggctcccatttgaccgtcacctcccctcctccaggtagctttctgcatccctcctggatgcaggtgcccccagcctgccgccaggcaccggggctgtactgtcacgcatttatccctccctgtggcccggggcccacctgtcggggccacacagctgtggtggtcaccaagtttctaggtgctgggtgttctcaccagtgatgtagatatgtggtcctcagaaggcttgagacaggcagcaccaccccatcttaaaaatccggagagcgaggctcagagccagcggtgcctggggagccactgatgagagagaagtggcagagagggggcgccgctggtctgctgggcgctcggcatctttatgggagaacgcacaccccttgtgactgcagtcagtgggagccaagccggggagcggtacctctgtctagctgccggcctgtctctgcagcccccaggcccccttctgttcgcagcgtgccctggacttcagggagagcagggaagctgagccccacccgctgtgggagtacccatgccgcagcctctccgagccctggcagatcctgacctttgacttccagcagccggtgcccctgcagcccctgtgtgccgagggcaccgtggagctcagaaggtgggtgcagagagggctggggggcagggaggggctgctgcttgcccttggagttctcacccccgtggtgagcacagctggcctgggagacgctgacacgtggagggggtattcgtcctccccacaaccttgcccttccctgtcagagtggccctgcgcgtgtggtggttcccacggtcctgtgtgtgccactggtggaggagccaggaagggctctgctccccctctacagctgaggctcccttgttggatcacagctcaggaagatgggagcttacttcctgtggtcaccgatgcaccattttcctgaaccctcctgggagctgaagcaggtcagggtcagcaagtgctgcttgcgtccagggacgggcagccctgtcctgctccggccctcaccccaccctcgcccgaggagtgacttctcctggaagcacctcccaactcggggcaggcagccaggcagggcgggcgccatcacctgagctcccagggttgctgtctggggcatcagaggggccttccggccttcagtgccaggctgtgcctcaagctcccccagaccctgcagccacaccggccctgccccatgtgtggcccggctgcagggctcgggttggctcaggtgggggcttggctgcggctcttctggctggggtttttctgaggaacgtttatgtaactgcagcactaggaactcccggcagggcaggaaggaagtggggaagaccacaggtttctggaaagccgcaggagctgcagctgttcccccgctgcctcttgtgtgactacttctgctgggcccccctctccttgacaggcccgggcagagccacgcagcggtgctatggatggagtaccacctgaccccggagtgcacgctcagcactggcctcctggagcctgcagaccccgaggtagtgcctgcgcaccgggcccagtgtgcgtgcagaccctgagagcaggcgccgcctggggaggcctccctgcccccatgctctgggtgtttctgtcacaagttcttcgggccagatgatgacccctcagtggtcctgggccatctggcccctgagcagcttctctctgctgcgagctgcctgggctggaggctggctaggaaggaggctcaggtgccagggagccctcaccatcttcctgctcttcttcctacaggggggctgctgctggaacccccactgcaagcaggccgtctacttcttcagccctgccccagatcccagagcactgctgggtggcccacggactgtcagctatgcagtggagtttcaccccgacacaggcgacatcatcatggagttcaggcatgcagataccccagactgaccactcttgagcaataaagtggcctgagggctggggttctgagtggctcatggctttctagcggggaaggctgaaggccctcctctcctctctgggagctgctcggcctcagggatgggaaagactgcgccgtgttgcatcttgttgcatctttgcactgctggcctctggctccagctgtggcaggaagcatgagagggtgactgaatttggagccctggaggggctgggaagacccccctgcttgtgcttctgaggtgctgagaatgctccaacacagagacatctctccccagctgggaagggagtggaagcacagggagcttgtggggctggccggtggggttgtccacgccgcccttggcgagcagtccccgtggcgggagcctgtcctgtctgtctcactctcgaggatctccgggtccctgctcttctggcttctgctaggagggtggagatgctgagttgtggctgggtctctggggcttgaagaccctggctgggcccgggctgagaggcctgggttctggccctttcacctgacaggtaacttcaagccacatccataggtgtctggcctcagtgctgcaccagctggtggcctgccaggacctgagactggacacaaggcagctgtcccagagcagttcctgagatgcaggcccaggaaagtggctgtcaggggagctgggaggcagccctgttccctgcacctccctcagattggaaagcccctcctgcaggtggggtatggcagggagcagcccctgcccagcgccgcttcaccaggaaggtcagtaggtgccgtggccttgcttctctcacacactaacccccctttggttatgtcccagctctcagaggtaacagcagacaccacgtgagagaacccagtggcctctggctcgcagcttagaaggtgaggcttgtgccaggccagccgagccgcctgtatgagcagagttccggtgtcctcggattcagggcagacttgggcagtgcctgtcctgcagttgggggcaggaactccctcccctgcccccaggcgtgcccctgaggcctggccccagcttgtcgctgaaataagtggagaacaccagccttgagcctcacagttttattttctcctcgttatccatccttcctttcagcaccagtaaggaaaaagaacacctctcttcgcaaaatattttatcaggtgtaaagacttgtttttcttctagggaagaaccgtctggatatatatttgataatgtttttaccaaaaccataggtgtgcttaccatagaaaacccctaatgtcccatgaagatacaatacagaaaaaaatacagaaattaaaaaagtttttataacagtatttctaaatctcagcaagttaaaaagcaatagttaaaaagcatcaagattaatatacttaaaacttaaggtggttttggacaaatgaaaatgaacatttccttcctcagtggcccccgcgccttgtggcttcctttgagactgggcctagggcaggaacagagtcttggtatgggcctcgggtgacccgtgtgcccacccctgctaggccttagatgccacagaatctgagatccagcaatggttcactttaaaaaatcagtggaagggcctggcctgcacacaaggcccgggagtccataggcagccacaatgagacacgtgggtgggggggtcccggtcttggtgctgagggaggtgtgcgggggcctgggggccgcacatccttactctggaccccaggacctgactaggcagaggcgaccttgtgatgacagaaaatgacttgcctaaggccgcctgtgaggtgggaggggaggagcatgcagccctgactcccacgcctgctgccccgggagggggtgcctgggtggggaagctatgttggggtctggtgtgggggccctgcccgggcctcaactgctctccctgtgcaggcagtcggcaggcggctcggggtctaggggtccagggccggccggcccagtcgcttgtgtgagcagagtaccagctgcttctggaagttgggggcctccacatcatgaatcccagtcaaggctcacaggccagcccccttggaggggtgggccgggcagagagcccagcaggatgctcgccctcagcagccccttcctggctctggactctggaggggcagggcttgggcccgggcagacggtgcttcccaggccaggtgagttcagacaggccagtgtcacaaggacgcacgtcctagcgccaggctccctgggctctgcagcgttgtctgccccagcacagggccaggcatctggctggctgcgtggccccctcttggtccctcttgcagctcaatgggtgacaaggcacagcatcagggcaccagcaccaggaggggctgacagcagacagcaggtcctggtgctccctccagcctcaccaggcaaagccggccctgggccaggctgggtgtagggccagggcgccacgaggagcggaggtcagcggggattgtcaaaaacagtccctcaagttgagtctcgaactttgaaacagacaaaaccttcgctgcatgacaggagcagccctggagtctcttaaaggcaggtgggcagaggcagtgctgccgaaggggcctgggggctgtaggcatcttggggctggaggcagatcggggaccacaagctgttggccagctctgccatgctgaacttgggtgccagtaccacaccctgccctgggcatgcagcaactgtcagccttgctgccccagcttgcgcactggtgagggccaggctgctctctgcaccttggcttcctgcctcctaggccggggtccccttgtggccttggtgttggctggggtagctgttgaggatgggcctgggaggccagagccgcagccccacccggggggcaggcaggggttcctgagctcagccggcacgcaggtggggcacgtccccagggagggattggtcccgaaccagagaggtgtcccgtgggggagaggattggcagaaagaagaggatgtgttggttttgatagaagagaagctacaaatagattattttcaaaatcaggatcccccccacccccgtttatgctgtgagtcccttcttcctgtaaaaaaaaaagtggatactctcttctcggatccccgtttatggctccactgcccagatgggaggctcccggaggaggcccagggtgccagagcctgccagactctgttgtgcctgagctggggaagggaccctgtctcgggaagagcaaagttctatgagtgacttacagaccctgtgaagtgagggttggttttgtgattaacctttttctgtttttctttttaaaatgtaattgcccttgaatgcgagaccctgggaagagccctgggctggctggtagagatgcagccctcggaccctgcaggagccggcccacactggaggcgggagagctggtggccgtgcccaggaagtgcttctttggctggttctgattgtgtttggagtttggccttgggtgaggcccgagcaaggggtctgtggctacagcgtggcacgtggcatgcgggcagcgtgcatgcgagggtgcaggcatgcgagacgacattggcagcagacaaaaataaagaaccctggacgaagcttaagaggagatacagagagtacacgaacccggtcctcatactaacccacgggttacaaactcggttgtgctgtagatttgtagaaaatcgtgttgtgaaagaatggcactggttaggcagctggaggctcctggggcgggcctgactcctctgtccacagtgaggcccagaggcgcagagcagcgcagcttccaggttcccgggcactgactgtggctccctccctgtccctgccctcctcccccaagcaccgggcactcgatggaggggacatggcccagggatgggctgcagctgcaagggctggcagaggccccgctgctccggacggtctatgcctcctcctcccccgaagacaccatcagtcgcatggctactggcaggtggtccgtcaggccggacagctgggtgataaaactgaattcttccacctcctggggtgagtgggagaggggagaaacagcctggtcagattccaagggcatcttgcagggagcggcctggggatccccaaagtgaggccccggggctggggtgggctgggaccttcctgcagtcagagggatggggcctggaggacctggggccctaagggtctgagggagtgatgggtatcattgtaagagtggcctggggcgtggggtttcagggagcggctgtcgagagctgcagggcccgggccctgctctctctttgcatggccctggctgctgggccctcctgactcacggccttccagtctgggcacagcccctcctctgcatgcagcatgtagtcgatgcgccggccgttgcccttcagcagctccttccgccccttctggcccgagctcttgctggtgggaaacgcca

SEQ ID NO: 12873 - DNA, 442 bp, Homo sapiens
aatccctttctggcactgttgccctgagacaagcagtatgcccgtctgcttcctgccagcctgtcccctggggcctcagcaccactgggccagaggcttaggaccccctcctgggagcccccattgcagagggcaggctggggccagggcctgggatggcaagtgcagtggtgagagaccctgcaaaggccgccaggtctgtgagtgcctggacggatgcaaaaggggcacccggcgaggcagggcctgcaaacatgggcttccacaaggttttcatcagccttaagataaatacactaatgacattcaggacattgttacagctcagaaatggaatccatcactgtcctttgcccttgataattaattccagcatcaatgatctgagagctactggtagtcatttttaaatcatcatctcataaaaagaattttctcagca

SEQ ID NO: 12874 - DNA, 442 bp, Homo sapiens; identical to SEQ ID NO: 12873

SEQ ID NO: 12875 - DNA, 3323 bp, Homo sapiens
gacaccttggagcccctcaaaacctccccagtggtggcccccacgtcagagccctccagccctctgcacacccagctcctcaaggaccccgagcccgccttccagcgcagcgccagtactgctggggacatcgcctgcgccttccggcctgtcaagtctgtcaagatggctgccccggtcaaaccaccagccacacggcccaagcccactgtcttccccaaaacaaatgccactagccctggtgtcaactcatcaacttccccacagtctactgacaagtcttgtactgtctgagggataataatttaattgttctagacaaggggactatagggactgactgttattaaaatcttcctatttaactagcttggggacttcagttgaaaattaggttctaagttgttcttgcaggaattagcctccccgtctcccaaaaccttgagaatgaagcccttggtatcgcctctcccttcccactgccctctgcttcccccagtcgtcgtaattcagccagctgcagtccgtaccgttcttaggttagccagagacaggttttcattatcaggtcactgtgaaatctggtaaggcagtcctgaggacatgggctcaagtctcagtcccctcagaccacggtgatgccttgaccagatggttggctactgccatccagctttcagtggcatcttgttttgggaactgattatagagaatcatatatagtccagtcttcattttacatacacacacatattttacacacacacacattttacacacacacacacacacacacacacatatgtttttctagtctctggcatgtgtagcctctcctggtcatagaccagtctctttgtaagttattgtggcagttcacacagtagccaccaggggtctctgtttccatcacaaactttgttctgtctgggccagagaacctagcctttgaaatctctccatcatatgaaacataacgggatgggacaatcccgtaacctgtttggggttgggggctttctctctgtgttctttccattgatgtgaattggtcattggtgtttgctcttgcctctcctccatcccctagaagtacacccccgtcttattaaggagcttttaaagtttttctgaatgtatagacatttctcgggttcctacctttgtctctgatggaccattttccatttaagacattttcctgtataagacagttttatagctggttccttttagggtaaagagtcttaagagagttttattgtgtctatggcaggtttgggaaaggtaagaaatgggtcctttttcctcctaatgtttttggcacttaaaacataaaattcattatcctattaaaaaattaaattcagctttgctaatccagaaattgttcccaaatgaaaacttgttttaagtccaccccttagtttccttattttacaaggtctctcttcagggaccaacaggggcttagagagccttagttagattaaagggagaccctacctcttaaaaccagttttcatttatgcaaacaaggacaattaagggaaccctgaccccacaggctctcaagtcttcccaaggccagaatcgaaagaaaattaaaatttgaatgctgaatattctggctctactctggccttttttctggttcccttccaaaatgcacaaatcatacccttgtctgctccaattcagtctccaaacctggtgcctgtgctcctggcccccctagcatcatgctatcccaggagtatcaggaccagacacatccacagccaggctcatgggtctcagacagcaacttgagttaaagctgaaactcatccttcttctctgtgttttctggtttaaaagctgcacttatattttagccttattattttctgtagttccggagagatggtgggttgccattctggtaggaaaatctgagttttcttatctttgacctagaagagattctttttggaccaacctgcgaaattggtagttaggtctatggaaagtggtaggatttttttttttttaatcctgtgcaaaggaaaagaggtgctttgtgggaaatcactaatgagaaggctaacctgcagcaccagagaaacctttccaagtgctaggcaggagaactgaagaactctttcagtgaagtgagtcagcctagaagaggcaacccacagtcttgatttttgttgctgtttcctgacctgttcttgcctgtcacctgggcctacacaggtcccaagccaacggggctttcatacccaaggatctgtttccttgctgaaaatgaaaccctatctttcactttacattcctttcaatccaactgatcaaaactggtacccacacttgccctttctccctctctccagcacactcccctctaagaaagtaaaagcaaagctttcttaatggcaacactttgggcctgttctgttgctcctgccttatttctctttcaaccctgtacatgactcgtgttcaccatccccttgatcagtgtccatccgcgctaatttgcatcatgaactgaacagtgtgtgagtggtcacctactaaacccagctctgggggcagagctgtcttccccatctctggtgctcctaacacctgtgagatggtcctgtcgagaggactaggaaccgataggaggagagtccttctcggcagagctcactgcaaacaactggaattgaggttgcacactgtgatttttacaccgaaaagccaaaaggagctggccatccagggcctagggagaccagccttcctcagctatgcttgccgaaaccagcatgatgcttcaaagagccctgctccacccctcatggcatggatccttttcctggtgtggactctgaagggtcagtcttcggggaagagaggtggggtggggctactagcatcccaatttagaaaatagaggagtttgtagccagcagcctgtaaactggaaacactggtctcagccaacctcctcagggcgccctggcttctccccaaggagatgaggagcggtgatgccagcaccgggatgcgcagagcactggaagggctggtgcagatctacttcccatgcagaagagaagtcacatcttccagggaatcgcaatgttgtggcgtctgacttgtatgtcacatttgtgtaaaatggtatattctttaaaatagtgttgataactggaatattgtatgtatgcttggagatgctttgtgtgaacctaagactgtcactcaacagatgttggattggggaaaatccaaagcacaacttcaaaataaaatacatttttaggtttcgatgctgcagttcatat

SEQ ID NO: 12876 - DNA, 383 bp, Homo sapiens
ctaattatgacaggacttgaaacagaatgattattttgtatgtgatatactgagtatatgtccactctggacatgtggacccaataagacagcttaataagtggtctgcctgtccctctctccccaggaagaacctaaagacagaataaaagaagcctagcttcttgctcatacactggctattaggaaggctgttgtaatttttaaagccggtattaagagtattttgaaagcccaagttttgagtctaaagaccttggtagactttagtgaaactgcccgactgttgaggatcaggtgtaatcctggccacatgtttatattgctgtgcccatcaccatcatcccgattcctaaggctagtctctggtaccgaatgggtag

SEQ ID NO: 12877 - DNA, 2105 bp, Homo sapiens
gagaccctaattttcggcagatccatgccttaaaggatcacagcagagcagagctttaaaaatgagtgcccacagaaatgagaggagatgctccccccatccacttaggatgtcttccttttttcttgtgcctcttttttttttgtcatctgaaatattacttgtcattattggggaacttgaggccgatcgatgaagtgtatatgtgtctgtcagacatttgaagaggaaaaacatgcttcaggaataaggaaaatgcctgcagtgaaagcaaagggtcaggatgagcttcagtgactgatgagttcatttcaaaatccaagggcacatagatggtaaattaatacatatggcaaatacagtcaacgagcaaaccccagccactggaaggaaagggaattttagctctgtagtcatcacatgcctgaacagagagtctacatatcttaaatgtagatccgaatcattgctcttttatcccgctaaatgctgattgcaaagaaatatttgggcattgttgactttccgtccataaagaaaggccaccaagattcacaaaatccatcacctgcactcatacatgcatgtgtgcttgaaattcccctaggatgtgaaacagttaggcagagaactgcactgtggtctcccttcctcacttctttccctccctgtttttccttttcgaaaatgtgatacctgatctctaggtcttgcgggctgagaaattttttgtatttgtataatgcagtgtctggccttccccctgacctgctgatgtatttttggcctcattagtagtcagggagatgccttagtgcatccagcactgcaagtcagggatgagacacactacaacaggagagggagcaagcgcgagaggatattagaagagaggcttgtctccaagatatggaaggaagtgagaaatgacagggctgcaagctttgtatgtaggagcccggcagggcgggggagcggcgaggagagccaagtggattctcagaaaaggggggaagccatcgaagagctaaaggtgattagagggggatattgatttcttattctgccagagatttaagcaggcatgcgaggaatctgcaccatggttggcaaaaagagacccgttgcctcctgtaaccagacactcaggctttccaggagcccagggagcaagccgagaagaaagggggcagtgtggtctaggaaaattcaacttgtcgctgatttgtgcctgatgcctgctgtccgtcagcagcctcccttacaatctttttttctctctctcctttttttttccttgccttctccttcttcactgaagcctaggggagccagtaaagattaaatgtgcttctcaaaggcagccacttcatgctgctatgtcgaaagggccattattattattatattttaatggtaaaagagaaaaggagagaggttgagcgagcgagagagaagctaggtgtgatgatgacagactagcttttctgagaggaaaaggaaaagggaagggagagaaaaaggagagcctctgagctcaacggaggattgtgcctgagaagaacccacagaggtgagaaaaaagttgtcttgaaggtgggggtgggggggctgctaaacagacactgtacagagggagaagagacataatttagctgtgttgctagtatgattccatttttaaaggaggggagggggagagtctagagctctaactgtttttagttgcatatggaaatatctaaaaaaatatttagcatttttactaagtgcgttgaggcctctccagtgtcctcctggctgtggctgctttgtcattctctttgactagccagccatctaccttgctcaggcctggaataaaagaagaacaagaagaagaaagaaatgaaatgaaaaacagaaagaaaaaggagaagaaacatttgtaaaagggtcatcttcccatctgcctcccctccttttcctttcatttttggtggcggcacaggaaagccccacttccagtctgatgaggaaagcgacaatctatcaggtacagaaccaggggctgtctgcgaagatggaggggaattatgcttcggattcctctgaaatattggcca

SEQ ID NO: 12878 - DNA, 2104 bp, Homo sapiens
gagaccctaattttcggcagatccatgccttaaaggatcacagcagagcagagctttaaaaatgagtgccaacagaaatgagaggagatgctcccccaatcaacttaggatgtcttccttttttcttgtgcctctttttttttgtcatctgaaatattacttgtcattattggggaacttgaggctgatcgatgaagtgtatatgtgtctgtcagacatttgaagaggaaaaacatgcttcaggaataaggaaaatgcctgcagtgaaagcaaagggtcaggatgagcttcagtgactgatgagttcatttcaaaatccaagggcacatagatggtaaattaatacatatggcaaatacagtcaacgagcaaaccccagccactggaaggaaagggaattttagctctgtagtcatcacatgcctgaacagagagtctacatatcttaaatgtagatccgaatcattgctcttttatcccgctaaatgctgattgcaaagaaatatttgggcattgttgactttccgtccataaagaaaggccaccaagattcacaaaatccatcacctgcactcatacatgcatgtgtgcttgaaattcccctaggatgtgaaacagttaggcagagaactgcactgtggtctcccttcctcacttctttccctccctgtttttccttttcgaaaatgtgatacctgatctctaggtcttgcgggctgagaaattttttgtatttgtataatgcagtgtctggccttccccctgacctgctgatgtatttttggcctcattagtagtcagggagatgccttagtgcatccagcactgcaagtcagggatgagacacactacaacaggagagggagcaagcgcgagaggatattagaagagaggcttgtctccaagatatggaaggaagtgagaaatgacagggctgcaagctttgtatgtaggagcccggcagggcgggggagcggcgaggagagccaagtggattctcagaaaaggggggaagccatcgaagagctaaaggtgattagagggggatattgatttcttattctgccagagatttaagcaggcatgcgaggaatctgcaccatggttggcaaaaagagacccgttgcctcctgtaaccagacactcaggctttccaggagcccagggagcaagccgagaagaaagggggcagtgtggtctaggaaaattcaacttgtcgctgatttgtgcctgatgcctgctgtccgtcagcagcctcccttacaatctttttttctctctctcctttttttttccttgccttctccttcttcactgaagcctaggggagccagtaaagattaaatgtgcttctcaaaggcagccacttcatgctgctatgtcgaaagggccattattattattatattttaatggtaaaagagaaaaggagagaggttgagcgagcgagagagaagctaggtgtgatgatgacagactagcttttctgagaggaaaaggaaaagggaagggagagaaaaaggagagcctctgagctcaacggaggattgtgcctgagaagaacccacagaggtgagaaaaaagttgtcttgaaggtgggggtgggggggctgctaaacagacactgtacagagggagaagagacataatttagctgtgttgctagtatgattccatttttaaaggaggggagggggagagtctagagctctaactgtttttagttgcatatggaaatatctaaaaaaatatttagcatttttactaagtgcgttgaggcctctccagtgtcctcctggctgtggctgctttgtcattctctttgactagccagccatctaccttgctcaggcctggaataaaagaagaacaagaagaagaaagaaatgaaatgaaaaacagaaagaaaaaggagaagaaacatttgtaaaagggtcatcttcccatctgcctcccctccttttcctttcatttttggtggcggcacaggaaagccccacttccagtctgatgaggaaagcgacaatctatcaggtacagaaccaggggctgtctgcgaagatggaggggaattatgcttcggattcctctgaaatattggcca

SEQ ID NO: 12879 - DNA, 2104 bp, Homo sapiens; identical to SEQ ID NO: 12878

SEQ ID NO: 12880 - DNA, 668 bp, Homo sapiens
cagcccttcccacttcgtgtctaccaaatgacagcctggtgctcgctcttggtgatttggccttgacttcagccaagcagctgatgcagacgaagcctccgtttgcaggactggcaaagtgcacgctaaagaaagaaggaagaaatttttcaaaaagcagctctggggaggtttcatactccccccccccccccgcctttttttaatttttaagtgaatattttccaaatttgatcagttccagcccctccctccactcccacccaactgcccttttttctctcgtcaaagcataagctacagagttacagtctcgagatttggtgtatcgcttcctgcccccgcctcccctccccgcccccgttctccgtcctctattgaaacacctcgcccagcctagcgcactgagagctctcattttccccccttgctcgggatggtgcccacaggaggctgtgcgggccccgctccgcttcgaatgggtgagttcagaacgctattcgtctttacacttctatagcctccgaatcctacttcttggtcttctcctttgaaaacccgatttctatgatttttgcatgcggcatacttgccctgggggaaagagatgcctcctattttctcttcagtcatttgtgctagtcgtaaattaaagctttgaaaagaca

SEQ ID NO: 12881 - DNA, 10316 bp, Homo sapiens
cccacgccgccccaaaacacgcctccagctggccccttgggacctcccttctctagtccgtattttgacctggcccgtggagattcgccactcccccctaccccaagcagcctgggcctcgatgggccgttgtcggggcccggagattgaagtggtgttggatcctgctgctggccgcgctggggtagaagggtcgccggtgtgtgggcagagcggcccccgcgtctcacctttaattttctttccttaggcggtaaccagcgtgagctcgcccgccagaagaatatgaaaaagcagagcgactcggttaagggaaagcgccgagatgacgggctttctgctgccgcccgcaagcagaggtagccccagggaggggagggaaagggacggtggagacctgggttagaccaagggttatagaaggaaagagagctacctcagggcttgaatgtggactagtcgtgaggagcagagtgcattgcttcctctagggttttatttcctccccaccctccaaattgttagctcacagccttacaggaaaggacgggggcgggcgcctgccctcagtctgatttctgagcgtccctgggtctgaccttaagggcaagggcagggagcttcacatttcaaatacagttgtggttacggcagcccagtacttttggccctccttgctgttcggttctcctcccttctcccaacctcctcactggtgttgctgggtgtggtcctcaatacagaatagagacccttgggcctgtgtcaccagacttctgaccccttggcaacagccagatggagactggtcgccttttgagcctcagctctcttcctcttgttctcctagggtgggagtacagcagccaaacgctgaacttagtcccatccacttccatcttatcctttgtgcccttcatccccctgcatcttgtcctttttgccctctggtacctcccagtgccccatcatctctacccccagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattccttgagcgcctggtttgactggggacttggggggatggggttggaagaatgactgccctttcccaccaaaaaagggagaactctttagattcagattgtgggtatgtagacttaataagtgaaacatcacagaagaagcctttattatacaatgacaaccaaacaagtactccggatatgcagtagaggaatcctctaagaaccatagagacttcttttctgtgatttttgttccccacccttgaacaccatctctaggatggagttggcctaagagtgaatgctgcaagatctgtgtttatgcctcttttcctcattcttcctcagtttgttcgtctgcttgaaagttggccaaaaaatcctgctgctcaccgacttcccgtggtcagctgctgtcaaggttcactttctcttctgtcattcctcatggaatgaggctggttttgtcttcccgcttcccttgacctcaaaatcaggattaaaacctggggtagcctctgtgctcctttcttccatgccctggtttgttctgtggttctgggcttcttatatccgtgtgcccagggctgaactccttattttcctttctccaagggcagagcgagtcttcagtccctgttggtctttccccacccccacttccagcccaagagccaggaaagggctggtgccacactgtctgctgggatcagcggtggttctttgagctgctgatttgggtgttaggctcttgagctgggatgcagatgtaacagtagctccagtgagtcagacactctgcccagcacattagactgtgtttgaccacttcttccagttcatagtattgacttcagcccaaacggagataactccctgtgtgtccttgaggtattgagctgggctggacagctccccttgagccaactctaggagtacaatgtcaggggaaccccagtttgtgaaaaggacttagactggaggatatttgttatctggggatatgatgcggtggcggcggcgcctcaagataaggggctggggtttctgggtggggggccaacagagtggtgccagtaacagccccagatagaggagtacgcaggcccagcatgaggcaaccttgacccagaaggtggcccagctacccttgatgaaggtcttttccagttctgctccctcatagctgtgtaaccaaaggctctggttagagaatatgaagggccttagcttttagacctgttctacctcctcaccaaatataatggcagacccatgtgtgtctggaatggccttgaattgctctttccttaaaatagctagctcttcaggagagtatctaaggcccactccatcttacctgaaccagttggtaagggtaaccatgacatagagtgaggcaaggaagaagacgaagtggaaggcagaatagttgtaggaaagatgctggacttggactggaggagctggaggggtttcttggtcagctggcctcgcagccccacccctttgccctggagagaggaaatggctgctgggagcagagctgctgaaacacctcttcccctctcccccaactacctttgttaaggctcttgagggttcttatggcactccacagagatctaccacttcttatggttcctcacttggcactcacctttgtctgcctccactgtttcagggcagcagaaacacagtgagggcttctgcaaaacagaacgcaggttttggaatggtcttaaaagatgtgagggtgttaatctaggaaacttcccccgtgaaaagattggtctagtattaaaaagtggaggcacacctgggttcaaattctagctccagcatataagtggctgtgcagactttggtaagatgtttaatcttttgtgcctcgatttctccatttgtaaaatggagcaaatacctacctcacagggttgttgtgagggttaaattaaatgagattatgtaaaagtatctagcacagttgcctagcacattgtgggtactcaataaaaggtaacagcagctataatctgagcattctgggtagaggttggtaggatgtgtgtgtgtctttgtgtgggggagggagggtgttggggatatggagctctttatcctcacctgaaactcatagctgtaaaccttgacaatccacaggggtccaaatacctcagccaggtaggaggcctcattgctgagaaagaatagagttcttaagctggtttagttaaatagggattatctgggggcatttactaccaattggtccatactggtaatcctcaaaagggtaccatactccctgtgcccttttccaccaaagatttagaattctattcatgtgagagccctaaggtctttggacatattttaaattctcaagtcattccccccacccccttcatctcatacagatcatctgacaaagtactattcttagaatttgtccctgtttgtggggagcttttctcactctagtcttgctctaaactttaaataatggtcccagacattgtcctgaccatccttccctgtcttgggcaccctcctttcatacctccacccttgacacctttacgcaccaagcaaaaagcacacaagcatacatgatgctagcactcagcattgctagagagatatctggtgtttggggttccattttactcaggccaggcaggcacagggtgtgattctgtccttgaaggattactgggaagggacaacagaagagatgggtattaacaatgagctaggtatttggcaggggcaaaaaaaggtcttagcatggagaatccaggtcctgtcccttacctctctctggaggacggctggacagtgcagagaaagtcagatacatgatatagcagctgatgacagaagcttgtaggaggccagagcggggttgctctggggagtaagtataattgctttagtctacaggctggtaatttcctccatttctacccccacttgtacttctgtctccccatcctttggtggggatagggaagcagagattcttttatcaaataattgagattagggaggtaatgaaacttgctatgcttttaaggcccccaaaacctggaatgctgtaggacatgtacccactgaggcggatgcaaggagcgatggagaggaaggagatgaggccacagaagcaaaggtgcagactgaggagcatcttgttaagcaggcagccagctgggtgtgtataatagtggaataggagcacagctcccacacctgccatgctgtagaatcctagggtggccagcaggacagccaggaaccagctacagtcttgagctgcacctgtctgcctaagggtggaaagtgggcaatggcttggagctccagcattttttttttttttgagttgggagtcttgctctgttgcccaggctggagtgcaatggtgtggtctcagctcactgcaacctccgcctcttgggttcaagtgattctcctacctcagcctcctgagtagctgggattacaggcacctaccaccatgtccagctaacttttatatttttactagagatggggtttcaccatgttggccaggctggtctcaaactcctgacctcatgatccacccacctcggcctcccaaagtgctgggattacaggcatgagccaccgtgcccagctggagctccaactcttttacccattaccaactactcccctgctctcagaagactggtgtgactagccatcctacttggcccacgcagtcatcacattcctaagcttttttgatactgctcagtgggaagctgtgggaccagtgctctgccgtgccttttgcccagccctttccatgtagtaatactagaaacctccccaggaaaagcctttagggttatgtgccccttaccagttcttgttccaggaatgggcaaaagctgtaataagcaccaactgcagtaggatgaatgcaaagcctccacagatgccaatgtaatgccatgctgcaagatgggcaccagtggaaaaatgtcaaattgttacttttttttttttttgagacagagtcttgctctgtcacccaggctagagtgcagtggtgtgatttcagctcactgcaacctctgcctcccgggttcaagtgattcttctgcctccacctcctgagcagctgggattacaggtgcgtgccaccatgcccggctaatattttgtatttttagtagagatggggtttcaccatgttagccaggattgtcttgatctcttgacctcgtgatccgcccgcctcagcctcccaaagtgctgggattacaggcgtgagccactgcacccggccattactcctcttcttacccacttgttatcttagaaaacttagcctactcctgccaagagtgtgggagggagagtacctgggaagagatgctcatcaggaatgcagaaggcaatagcacagagacctaacaggaacagcagcttgaggagccagaagctggttaggagggagaaagaaaaacagactcaggagaaaaggcaaaggacagtgaagagtgcctatggggaaaggcaaaagagaaaccaaaaatataggaaagaggacagacgagacaactaaggaggaaccaatcccaaatgagagggggttgggacaggcctactgcaccttattccaaattctaactcaaagatacttaatagcatctgggcaatgttttacagtttataaaggattgtgttaccaagataaccccactgttacctccattttagatgctagaagcacaaagtctggctcaaggttacacagcaagtacacgagaagcagggacttaaacctgttttctgtctttttacagtgctattacttcatcccggaatttcctttacccagcctatgtctactttccctcctctgtcccctccccacccagaaagtacacacaaacctattatgcagctgtgcccgcgggctggtgggggagtggaggtggaccagcaacacagcctgcagcaggtggaaggtggcggttcctgcacatactcggtacacagccccagagccactgagcactggacagtcagagaggccaaacaggtgggcacacaaccccgagggcatctggatctgggagtgtgtgtgagagaaatggcaggacaagtcataatgcatggaaaggtacctacttgtcacgggtatgaccactcatttgtctcctgcccccaaccgaaaccttttctatcttagggtttttccttttatctcttcccacctgacaacccgaccccctctcacttaccctgtgtgtcttgccccacaccctttccactactgtccttgacagcaggaggcagcagattgctgaggcccccacatggaggaggatgtagaacaggcggctgcaagtggatgcggtgagagagggccacctagagtggcagcagctggcacaaggagcaggcccacagcagcacacctgggagtagagcagatgcaaggcagcgaggtggagacttgctgaggaaaggcatacgttaatgtatgtgtgaggttaacccaggaggttgaattccaaaatttccccttcccctttcttccttttactcaggttctgtttcaagctgattccagccatttgggattgccgcccactgacaacttagtagggctttcattataagcaggcttgagatatctgacctttctctcgacctaaacacctggggctggaaacatggcgggagagatttacagattatacctggggcaacgaaccagaacgacattagaggagaaaagaggcctgtcgtttttattggcttctgcacgtcttcctccccagcttcggccactctccccttcgcaccctctcacctgacagaagggacttttcactaggacactgctgcctccgctgtgctgctgtgccaggcccagggaggtgccggggctggggccggccttggcacccaccatccttgtcccagggattaggcttaggtccaccagatggaaggcagatgagagcagcagttgcttctgtcctcagcccattggactgccactgtgttggggctgagcacccggtcccgggcagaatggagacgtccggaagagaacactgacctccaggttgcggtaaatgcaaatgccctgtgaaggagctttgtccttagggcctcaacactgcggccactcaggctgttctctccagattagggggcagtttgtctatctggccccctgtggattagcattctttattggtttaggattagacgtcattcaggttgaacggagttccctgaggtgggtgggtgcgtgtttatgtgttgaggggactattcctagtttatgaggtggttaaggatatcggtggggtgggctggagcggtgtcgggttaggtctgagagaaggcctcgcacaaaacactgtacaaacccgaaaggaagtctgagagacgaaccgccttcctccctgaagcttctagaactggagcagaaagaaggtgtggcccagggccagccccgcctcctccccgggcggaagctgtgtcagttgccggaagtcggcgtgaggtggggcttatgcggcggcgtggtgaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggtaaggttggccaagagcatgtcggggcgggctgagagcagaggggggctctgaggctgtagctggaagccagcgctccaagacggggttctgatcccgttggcaggaggaggcaatagggtagagccgagggaaacagcggtcaccggagcgcgccgcttgcctaaaggagcttgatagtgggcttaaggggacctcaggtgcatagaatggaattaaacatagtccttgctacctggtaacacttgtcatcgtgaatccatgcatgaaccgcttgttttgttggccttttagattattgggaattgtgggtagcggtgcagtaactagacctgcctttcccataggccatgtctgtgattggagacagaaggtcccgggagcagaaagccaaacaggagcggtaagtcttcaggggcagccaactttaacagttcttccctccccggtccccagacaaaaataaaaaccattattaagcctttataccgttcttcaaatttatcaccaattcctgcagatctaggcgccacaactttactcttgttagcagaaggcctcctggcaacacctgctgccaagactccaggggaaaggagtattagtgggagtttttattttcaatcaagggtttatcaagatttatttacagggcacttctgggaatgacccttcctgggagtttatggtgttggttgagaatgaggactaatatatttaaatatttttgcagggagaaagaactggcaaaagtcactatcaagaaggaagatctggagctaatagtgagtggtagtgcctaactagtgtatgcggaggggaggctattctgcttaatttgggttgtttcctgaaacaagcggagtcagtatatttggtggcacattaatgcctgggaacctatgtaacatgatttttttctgcagatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttcagttttatcatcttgggtcaagtagagtgtatactatatcctatgttgtggagaatttatatgttggagactaactgaatttaagtgacccattaaaatctagcacacctgtatgaaaaatcagtgtagaagaatacctcatgtgcagatgctaggtggcaggccagtctcattcatctgactagctctcaacagtattcaaggtacatctggagtctcagcagagttactgtactcaaatggcatgtgtctccaagacagcttatgaatatctaaaaggccagctacctgcctaggagccactatatatatagatagatgtaggttatgaacccagttcataggccaccttgagttagaattttggtacctacaacatgcttgattttgagtgattaaaaaaaaataatttggctgggtgctgtggctcacacctctaatcccagcactttgggaggtcgaggcaggtagatcacgaggtcaggaattcaagaccagcctggccaacatgtgaaaccccgtctccactgaaaatagaaaaattagctgggcatggtggtgggcgcctataatcccagctattctggaggctgaggcaggaatcgcttgaaattggaaagcagaggttgcagtgagctgagatcacactactgtactactgtactccagcctgggggaaagagtgaaactccatctcaaaaaaaaaaaaaaaaaaaaaagcccgggcacagtggctcacacctgtaatcccagcactttgggaggctgaggcagtcggatcatgaggtcaggagttgaagacaagcctggccaacatggtgaaaccctgtctctactaaaaatacaaaaaaaataaaattagccaggcgtggtggtgcatgcctgtagtcccagctactcaggaggctgaagcagaagaattgcttgaaccagggaggcggaagttgcagtgagctgagattgtgccactgtactccagcctgggtgacagagcgagactgtctcaaaaacaaaacaacaaaaaagaatttaggggccaggcatggtggctcatgcctgtaatcccaacaccttgggaagctgaggcaagacgatcacttgagcccagcagtttgagaccagcttgggcaacacagtgagatttcgtctctaccgcgctccccccaccacc

SEQ ID NO: 12882 - DNA, 1352 bp, Homo sapiens
tatgtatttaccacctcatagtaattatttgcattcatttttatcgtacgacactaaactatttgattcttccagtgggacatttaaaggatgtgagaagaccttggtcttctcaaaaacatctgtatttggtcatggaataaatccagatgctacctaaagccaagctagtacctgagcttgtttctgagatcaaagggaattatcaaaatgtgaaacaccttctgcctgacaattgttatcttttactttaataggcaattaatacttgtcagcttggacattttatttccagtatcatgctaaaaatctccttgttgtgtgattcttttatttcttgacatgcacacatatatggatcaaaaagtatgtacaactagaaaaacggactccaagcaaaaatggaaaacatgtttccatgagcttagatttccgggtatattactcctaaacctaaggtagaagtaatgcattgttcacttacatgtccacttttctaacccaagctaagggctggaaaaagaaagtcagaacagtcccaagtaaatatgggaaaccatagcagtgataaaacctaagatttctcagaaatagttttaagtgggaagcctctaatcctacctggacagtgctttcctgtgggtttctcagcatgagtccaaacctcacaaagcaccttcaaagtctgggctacccagtatcacaagtatagcagtaagtccaatatctggatacaggggccaaggaaacaatgaaaaaaccaaatcaaggaccagatgctgagactccccttgtgttccacagttggaagaataagcagttggaccctaggtagttttccgcttcttggcagatggccgctcaaatacatctcgtaccccagctgccttttgtttgaagaactttgtgttctgggcactctcttggccccaagctgagtcaaaggaggtggtatcttgatccacaaggtgagtgtatttggtgcgacctgagcgtccaaagttcttgacctgagggaaggatggatgatgagttataccaccaaacaaaccatgcctcagctatcaatacatcacttttctctgtcatgttattaaggttccccatacctgcatgactttaggaagaatggttttattgaaatgatcctccagggtaggagcgctgaaatctctcttgtatacttcttcatcctcatcctgtataaaaaaaatcttatcaatcttgtggctttatttcctatatattcaaaccacaaatttattaaactctacaataagggatacagagaaagcagagggtattgagcctttcttcaagagcttacatctagttgaagagatgacattctt

SEQ ID NO: 12883 - DNA, 10020 bp, Homo sapiens
aagtgtctcacgcttcatttaatctgaagaatattacaggctctccgtcttcagatataaattatttataacgttacagaacaagcagcgaattcaaccacttaagaactaaggaagtctacatggtgttaattgctggccacagtcctcccgatctggttttttaaaaaagtcccccgggcccccatttcagtagacgtgcaccatgccgtagaggaacgtccagaacaggacgtaggtgaagaggcccccgatgaggcctcctgtaaagagaggtctccgtgatttgaaatatttgttccacctccttcccgccttgagaatgaggagcagggagagcaggacggaggcgagcaggtagaagatgaagccgtagaggccggtgaggccgaggatgccggccgtggcccccgacagcgctgacaccgaggtccggcaataatccaggacggcggcgttgccccgcacggccgcctcgctgatgaacggcggcccttcccgcttggccaccaccgcggccatcgcaccagcccgggctcggcctctcgctttctcgcggaacaacgcggagctgcggagaaaaccaagttacaagtggcgcccggagctcggtgagttgggttcacgccgccccctccccctggagcttccgagacctggcaccagtcctgggcctcggatcttccaaagacgccgaggagattgagggtccgggccggccgggaggtggtggcgcgtctgcgttccccggccacggtggcccagttacctggaacacggcgccggacacactacttagcgttccctcagacgggcagtggaagaaatgcccgcggcgccatcttgctcggaagactgccgggaggtctcgggctgcgcacgcgcccagatcccgccccgccctccgcgcctgcgccgtgggcgccccggacacgctccgccctctgcccgcttttctgcgcacgcgcagggacttccgaaagcggagtggcgctccggccagtgattggctggaggtttgttaactattcatgagggggcgggccgagcggggcggcctttgttaagcagcgagggcgcgaccgcgggtactctgctgtcggcttctcggagcggcgctgggcgaccagagcagggtcgagatgtcctacatcccgggccagccggtcaccgccgtggtggtgagtgcgcttgcgcgggctcctcctcgtcttggcctgaccccacctcgcagagcgggaaacggacaccccaagcaggttgacagagcatcgaacccggggctcctgcgaaccggcggcaagggctcgggtccccgctttgccggagcgggccgcagttcccccagccacgaaacagggatggccgggacccgagagcctcccgagaccctggacagagcccagactgcgtgcgcagggcggggagggccacggggaaaggcctggctgcaggagcctggaaaagcgcccccttcccgggcctccgtgtccccagacggggagctgctgggggcgggcgccgatcccgacgtccatgagtcgcagcctctggaatgaggaaatgcttcctccgctgcagcctgcgccgccgcccggagggagatctgggggtggggctctcccgagcctgccgtggcagcccctgcccccttcctgtccagccttgctcctccaacccactcgccgcctggtccagggtggacgctcgtatagctgcgatgagcgtttcctcttcgaacttttcctgggtctccagcccttaaggcaaaaaagtccaggcctccctcctggcacttgagtcctgagtagaccctccgggggctagcctaggcccctggccgccctctggcttgttttaggtgctgggtgctattagactaggcagagggaggaaggaaggctgggacgttagactcagacgccggtgtcacagagggacacaaccctatgacagaggtggggagtcccagagagaagtgctcagccagaaaagaccacctcaggaaagactcaggtctcctgcctacctcccgacagcgttcagagaatgagaagaaatgcctgcccggtgggcagtaggtcaagcgaaagtccccgccctggagccatagggactgggtgtgttatctcagttgggtgtgctggagaagctccagcaatcaggtgggtggaggcagagaagccactgataaaggcgacaagtgaggctgagcttagagcactggctcaggcctgggccaggaggaaacattgctggaccagctgacagctgtcctaagcttcaccctccctgcaccagcttgactttttttttttttttttttttgagacagtcttgctctgtcgcccaggctggagtacagtggcgcgatctcggttcattgcaacctccgcctcctgggttcaagcgattctcctgcctcagcctcccgagtagctgggattacaggcatgcaccagcatgcccagctaatttttgtatttttagtagaacggggtttcaccatgttggccaggcttgtcttgaactcctgacctctggtgatccacctgcctcagcctcccaaagtgctgggattacaggcgtgaggcaccacacccggcccagcctggcttttttagatccctacctgccccagagagaaggcaccaggtttgctctttaggtagaaggggggcagggacaggtgaggagctacagcaagccaccttctgcgtgacctcacccagcaaatcagtgacagccctgtctcccaacccaagggcctgtaatcttctgaccgtgccggcagagcaggcctggaggagctcagtttggggcatgaggacccaggcacagtaggcctcatgcttcctgcccccctccctcacgccataactggtcccagggccttccccaaaactgcaggcccatgccccctaattctggtaacaccaggaacgtgcctggacatggtgtgtatggtctggcctctccctcgagtcttggattggggatgggtttgggcaggctcactccccagtccccaccctctcccatgtagaatactgagaatattaaagacatttaggccattcttctgaaccctggctccatagatccatctgccttctggacacctgccccgcagctcctggcactccaacctaacctgctcctcctcctcctgggtccccatctgagtaatgtgtgttcagccaggcacggtggctgggtgctcctcttgactcctctcctccatgagtggtccctaagtctgtagatctccattttcaggtagctccatgtcccccggcctctgcaccttgcttttgtgagatgtccgttcctctactgattacctgagtggtcattctagcagcaaacctgaccatgccctaccctactccattcctgagaactccagtgggttcaggatcaaggtcaggctacccatcaccccctcaaagcctggtgcaaataatcctccctttgggaaacttctttaggtctagtctagattgtggtcttctgcttttttcttttctccttcctgttaaaacttgactttgggagtgatctggtctggctcccagcatctgctgactggacggcgcttgccaagggctttgaaaagaacctggcacagttggggaccatagccccagagcatggtgggaacaccccagagcatggtgggaatgccccagaacactcgtttctgcacaagagcagggtctggggcttagggagacacccctgctccccttccaggacgggatctggccccagccttacactttcagcctcatctcgcctcccagttctgtgtcctgcactggacactccagtctcacgaacacgtatccacggcaccctgtgcgctggtccccgtggccggcaagcccttcctctcctttctttttttttttttttttttttttttgtagcccagagatcctttattttttttttgtttaacacctattatgccatgaattcatagggaataggttccagcagctcaggcgccttcccgttggttctcacaaagtgtgcttccctgggtggagcaggctggtgctttagttgaacccaggtacctttctctttggcttctttctttttctgatcattttccttcacgcgttccaggaagctatctcggctcttagagtgctttatgtgctcaatacgcacattaattctcttggcaagaatcttgcccttaacttgtttgtttacaacaatgccaacagcatgctggggaacattgtagactcttccagttttgccatggtaacccttgtggggcattcctttttgaacagtacccattcccttgatgtctacagtatcacctttcttatagattcgcatatatgtggccaaaggaacatctccatgttttctaaaaggcctagagaacatatatccggtgcctctcctctttccctttgtgttcgtcattttggcgaattactggaagatggcggttccggccgaaaggaaaccccttcctctcctttctatgcaagtttgatctctgcttttccagagcacctcctgtgagacgggcttcccacctacagaagccacagcacctggactcttgggccagcaggggcttccaccacatgttgaccaagactagtgcctaagactaacaggggaagtggggacaggttgaggacacagggctgtgtgggtggatcaatgtggccaagttctgagtgccagctcctcagcctcccaggctggtgagcagctggattcctgcaggggcctgggacccagccccttgtcatggctctgaggctgctgctgggaacacccaccagcctaattctccaaccacccacttctctcaactggcttttttctttgccagcaaagagttgaaattcacaagctgcgtcaaggtgagaacttaatcctgggtttcagcattggaggtggaatcgaccaggacccttcccagaatcccttctctgaagacaagacggacaaggtgagggggtctggggtcctgggaccgctccatggggcacaggggcctgagatggtgggtctctgcttcctgggcctgcatggaaggaacagacttcatctctcaaaccatgctctctaagaaggcatcggaagtgacctagtgagaataaggacgggtggggtgaggaagggctgctcagacagagcccaggaggagcaggaggcggccatcagcagggccggtgcatggtggtgcagcaactctgccccggctctctcagaacagtcctcactgaccatatgtgctgggagaggctgggtgcagggacagagggacggctgagaatgtgccatgctggcttccgctgtgtgataaggggccagtccagtgaccacagggcttgacttgggctgcccctttccagggtatttatgtcacacgggtgtctgaaggaggccctgctgaaatcgctgggctgcagattggagacaagatcatgcaggtaacaggtgtcccaaaggaggagaaataaggtttgggcaagcaggtctgaagcacttgggggtggggagctgccccagcctcccagctgggagagactcactgcagccaattgggaacccatactggcattgccccagaggacgctggctttctctcctgtgtgtctcagccacagtgcttggtgtctcccagccctgggatgttaggctgggggcctacttgaatgacctgggcccccaaagccctctgcttccagatcccagagggcggggagctgaggtgagcctgtgttctctcctggggccaggtgaacggctgggacatgaccatggtcacacacgaccaggcccgcaagcggctcaccaagcgctcggaggaggtggtgcgtctgctggtgacgcggcagtcgctgcagaaggccgtgcagcagtccatgctgtcctagcagccaccaccatctgcgactcctgcctgccgcctctctgtacagtaacgccacttccacactctgtccccatctggcttctgctgaccgctgggccccagctcagaagggctatagctggtcccagaggcctggcctggccttccttcccttctcccatccctggcctggggcctctgggaccagcttttttcttcttgacaccgaggattggaaataagggcctggagctgagtagtagccagtctgctgtgaccacaggctcaggtccgaccctgctgcttggccacagcagtggctgggcaagtgggaaccactatctcttgggagcccccaaaagctgggaaatgctggaggaaccaggcctttcccgcttttgcctggctgcagggttcggctccgcccctgccccccagccctcgtgtgtccacaccgcagtgcctctgcccctcgggggactggacacacatcctgccagaggcgctacgaagctttgcccagatgaagccaggtgggctccgcgttcactcccactctcccgaggggtgctggcctccccagggtttgccttcttacggatttagacgaggttcgaggctcacctatcagggcagctctcaggattgtcattttcctctttgcctgtgggtttaacttttgtatttttttaatcacaagtttgatacaaaatgtttttatcgtactctttggagatgcccattctacttttgaatttagcttttactaattcgcatctggaagctcagcaagtgcacaagccttactttggttaccgtggaaaccactgccacccctccccgatgtggtgcgctcaataaaaatgctggaattcacagggggctttgctgaggcatgggctgggatatcggggtgggggtggcggtgggatattggggccagagctgtggttttaatgatggccccatcccccactgttctgggacaaagctcaactactcccaggcccacctgcctggaaagcccggggctggtggagccgcagcagctgcactgcgcctgaccagaaccacatctgtgggagtgtctgggagcgctggggtgggaccctggggtgcgtgtgctttcttgggtgttactgtgaagcccctacttgctcccaacctcctttttgcaacctagcctcagctcccacctgggaggggccgtagggacacccagaggtgcctgggagagacccctgcctataagactccctgcctataagggcactccgtgtatcccagcgagggacacaaccccacgtgttgctgggggccgtgatctggccagatgggggtgagtcagagagcacctgactacctgcgtaccacctctgggaaggtgttagcactcctggacctacctagcactgccaaatcagattttaaagaaaagtcaataattttttttttttttgagatggagtttcgttcttgttgcccaggctggagtgcaatggcgtgatcttcgctcactgcaacctccgcctcctgggttcaagtaattctcctgcctcagccaaccaagtagctgggattacaggtgcccgccaccatgcccagctaatttttgtatctttagtagagatggggttttgcaatgttggctaggctggtctcgaactcctgatgtcaggtgatccatctgccttggcctcccaaagtgctgggattacaggcgtgagccaccgcactcagccggaaaagtcaatcatttgaaatctctgatttttaaagtagggcacccagtaacacatttactgggtgttgcaagtgaaacaggtctgtggaccccgtcaggccaaagtctgctctgcagaaacaagacctgacattctttgacgtttgttacaactagatagaggaagcgtctggagaataagacccccactgcccccgctcccagtgctggtgtgcccctcagaacctcatccaccccggctcacatccagattgagtggcgtgccctggtaaccgtgaagacacggagcctgggagactgacctggccctgggcgggtaggcgtctcgcgctacccaagagggctccccagtgaagtgtggggtcagcacgcagcgctctcgggtcagtgaccttcacaaccttatgcgcttccttacacgaggggagcagggcacctggctctgaaggccagcacacctgccttctgtatcgagcacacagagtgcagaaaggaagcgagtaggttttaattcaagatacaggcccctcgcgttgatctcgtagaaggaaactcagtggactgacaagctcaagtcatgtatgaggcacgtcctgggacccccacccctcctgccataggaaggacagctttgggcagagggaaggaggtttgagatcagggttgggcccatacagattgtgtgaggtggtctcaagtacaaatacttatctgaggctcctgaacaggccagaaattggtgagtctcaagtaggtgtctggggaaagagagggaaggggcctgccctcgctccaggggagctggtcgccgtttggcaggcctaacagacctctaaggcacagactggtagcaggagagagctatgtcctgtactccagatgctgggtaaggagcagctggatgtgctcagatggggctcttctgagaaggtggaggtaggagagagggcagaagagagtaagccacttccaaacgtccctccaaaaaatctgaaaggagttactatgctaatgcgctgggcatgaatccaattcagaaccaatctggtgggcccctcatggctcagaaatactctgggtagggctggctgttactgcagtcacggacgctgagttatgtacagagagtacgtcaggaaagtggccttcagagaaagagccccatggcctaaccccaaagtcctagcccgtccaccagcacctctgagttcactggccacggcaccgggctgcttgatctctgggaatgcagcggtggcagcaaagtgcccttggctcacccggctgcaaggtcagcccttcaagctgcttgcagaaacgctggtagtttggggcaaggccttcggctgcaagcttggtgcccagtcctgcctgagacggctgccagagcctgtgcgcgctgcctgaagccttaaagaaaagagatggcggtgtcaaggcgacggtgccacgtgcctggccggggaggcccaggaggggcccggacgaaggcaggctattgaatggcctctggccccaggagcagagtggtctcctctgtccgcacactgagccagccctgtgtgccagggcccaaccgcttctccggccttcgctgggtgaggccttccccagcagggcacgaggccagaggctgggtacactgggtccctgggtgctagttcagctggtcataccccggtctctttctgtacaaacagaagtgctggatgaagaagacgacgtcgaagacgatggagaagaccccgagtccaaacttggttgggtctccgaagatcagcgtccactggtctgttagcagccgggggacagaagctggtgttaggttggcagctcctgaggcagctggagcttgtggggtggtgggcggtgggggtcccagaaaaccacaaagcctccagctacgaaggcccctaggtgggtctctccttgggggctggattggcttggatcccaggtgggggtggagccctggctggaaggtcccgggaaggctggccccgcccgatgccccagccgcagggtggccagcagcccgctggctgactcaccgttgttgtaggactggaggaacatctgcaggaggctgaagctgcccccggtgaagtccaggagcacgttgccaatgctccagccctcagtgcttttgtagtaaaagttcatgtaggcctgggccagacagacggacagacagacggagggcggtgagggctgggcggctgcctcatgcgcctcgtgactgcccctccaaacaaaagcggttctcattcctcccactggggccttggctccaaggacacggtgacctttgggctatgacaggcctcagccaaggaacagtttgggtggtcctgggggtaggcgtctcatctgc

SEQ ID NO: 12884 - DNA, 469 bp, Homo sapiens
gtcactaaatgaaatggaactaaaatgacaccatatatacctgaaagtagtggttagtgggagggaacgctggcctgtgaaaggtacacccagcaaacatatcaagagcaaattaagagacctgcatttgaatcctggctctgtctcttcctagctgtatctcctctgggagaagtatttaacctctctgagtctcaggttccttacgagggagctaacaataacatctaccctgtaaggttattgctaaaattaaatgagaggatcggtgtagagtagaagtcacaatgccagcatatagggaactctttttttttttttttttccctgagagacagacggagtcttgctccatcacccaggctggaatgcagtggcacgatctcggctcgctgcaacctctgcctccagggttcaagcgattctctttcctcagcctcccgagtacctggcattgcaggcgcgcgcc

SEQ ID NO: 12885 - DNA, 2193 bp, Homo sapiens
tgcggggatgcgccccagtctgactgcctgtgccccacgtcctcccatgctgcagagccctgtgggtcctctgactgctgtgacctttccttcccccccgtgaggcaggtcctggcctctctggtggcctcccagtgagcctctagtcagtccctgtctgtgtcccggctcaccctcttccgtacttgctgctgcccctccagcagttccaaacgtctccaacctgggctcctccatccccggtttcttggccccaatccctcccaccctcagggactggggcccacttccccaaaccttcccctcctcggaagccccccccagctcccgggacctgaccccagcttcccagcttcaacatgctcaacactgttcaaccagccacatcccctcactgccgccctgtgtcccgccccagcctctgtgcaggctggcctggcccggaacgcccgggctccttggccacagaacttagtcctgctcagcctaagagtccagtcctgcctcccagtcagaacgctggccctcctgagctcacagaacacgaggctcccagggctgggggcactggaacaaggcttctccctttgggaatggggtgagttaaatgaggccctaggtccccgggtgcagcaacttcagccctgaccctgtcccaggctgtggggcaagatgtgctggaccctgagtccccggatctgaagaggaccggctatgctcataggacgggctgagctctgcgcgggaaggggctccctcctcccacctcacctctccagagtgtcctgctgtggaaatggaggcagtggtgagggcagagccaaaggcatcaggaaaggctggggtgtggagaaggggaaccacccgcacaccccatgcttaggggagcgtggggtccaaggggcctccgctagcgatctcctgtgattccagccccgggggaagagcggcaggctggcctccccaccgccccgctcccgctgggctcccgggctccctgtggctttccgtcctgtttcctcacgccggcaggagctgccccaccggagcagggcctgggccatgtagctctcacctctcctgccaccggccatgtgaacagggccctggaggtacctgtggaaaatacttgaccagcgtgactgcgagcttgatgtaggagaagcagaagagaaactgcagccacgtgatcactcccactgcagccacgatcatggtgacaaatgcgaagagccacgcgagcaccaggaagccgatggcaggccaggacacgcgctggccaccgcgctgggggcgagaggagggcagagatgtggacccacacagaggccacgccggggctgagcaaggacggccccggatagggcgggcttagagaggggcacggaggctggaccctggccttgaaggagcccctgcaaggtgggggctgcactggggttgtggcaggggaacatgtggaccacagaaagcatcacacctgggctggtgctggacatccccagcaccaaccacaccttctcatcgccagggcctcctgttcaggctgcttggactctcaagctctgtctgctttgttcctacttggcagaactgggcgcctctcagcactcacttggagacgtggggtcggaactctggtggcctggtgcctctcccagccaggtactgactcgtcccacgacccggcagcagcctgaggatctcaggaatctgtcccctcgccttgcctttccctgaacacgggcccaatgtgggccaccttcactctcgcttcacaccaaaagctaagaaagcctagaaggttcatacgggtggggccagacagcccccggctggccttacagtgtgaagggaactccctgagagaagggaaagcaaagctgtcatatcaggggtccccggacccagccttggtggggccctgccctgccgacacccatggcttccagcaacaaagctgaatacaggtgtctccgcctgcacgcgggccccctcctggcaccctgaagcccagctgcacccgcctgctcagggtccctctcaaatgccccttggcctctgtgacctgacccctccaggagcccaccctggcccctcccctcctccataggaacttcactcatccttggagcccaaccaagcgtcttcctctgccctcctcccttctgtgccctcctccctcctcccttc

SEQ ID NO: 12886 - DNA, 102 bp, Homo sapiens
gattattagttttttttttttttttttttttttttgagatggagtcttgctctgtcacccaggctggagtgcagtggcgtgatctcagctcactgcaacctc

SEQ ID NO: 12887 - DNA, 93 bp, Homo sapiens
tttttttttttttttttttttgagacagagtcttgctctgtcacccaggctggagtgcagtggcgcgatctccggtcactgcaaactccgcct

SEQ ID NO: 12888 - DNA, 98 bp, Homo sapiens
tctaacttggttttcttttttttttttttgagacggagtctcgctctgtcgcccaggctggagtgcagtggcgcgatctcggctcactgcaagctccg

SEQ ID NO: 12889 - DNA, 101 bp, Homo sapiens
ttcttttttttttttttttttttttttgagacagagtcttgctctgtcacccaggctggagtgcagtggcgtgatctctgctcactgcaagctctgctccc

SEQ ID NO: 12890 - DNA, 101 bp, Homo sapiens
actcttttttttttttttttttttttttttttgagacagagtctcgctctatcgcccaggctggagtgcagtggcgcgatctcggctcactgcaagctctg

SEQ ID NO: 12891 - DNA, 129 bp, Homo sapiens
tctttgtttttttttttttttttttttttttttttttttttgagacggagtctcgctctgtcgcccaggctggagtgcagtggcgcgatctcggctcactgcaagctccgcctcccggttacgccattc

SEQ ID NO: 12892 - DNA, 93 bp, Homo sapiens
ttttctttttttttttttttttttttgagacggagtctcgctctgtcgcccaggctggagtgcagtggcgggatctcggctcactgccagctc

SEQ ID NO: 12893 - DNA, 545 bp, Homo sapiens
ttctttttttttttttttttttgagacagagtcttgctctgtcgtccaggctggagtgcagtggcgcgatgtcggctcactgcaacctccacctcccgggttcaagcaattctcccacctcagcctcccaagttgctgggattaccagagaagagactgaagggcaaggagggaaaggaattggttcccaggtccatggacctcttgtgaagcccccattgctgtggggtctgaggaaacacagaggaggtgtcagctgctctgcctgcccccactcccctgccaacaacgtagtaacctctgtgcctaacctctgagccctggcctccaaccctgggagggaggtacttatgttatccgcattgtgcacgtggagctcagaggggcagccacttgccaggccagcaatccaggctgtctgtctccagagcccaggcccccagtcaacaacttgccaggtgcccctctccaggcctcggcttctccacctgtgggtcaagagcaccaggcttgttctagagctatcttctcagacctgatgtggg

SEQ ID NO: 12894 - DNA, 4802 bp, Homo sapiens
gaattctctttttttctcccgccgattgctcggaagttggtctaaagcagaggttggaaagaaaggaaaaaagtttgcatcgagactggatttatttgcacatcgcagaaagaagagaatccaagggagaggggttggtgcaaagccgcgatcacggtgaggcacgtttggctcttcccctcctggcgccgcggccggcgcgttgtgggcaacatggagtaggtgcagccggaccaggagttgggtccgtctctccccgagcctccctttctcaaatcccgcagggtcttcgcgaggatccggggcgctccccgcggacctgcctcgcccggggcttgggctcggcctgcctctgcggggacttctgtatgcaccccgtgcagtgtccccgacaggcgaccccgcgcgcccgcgctctagggggttgggacggaggacagctagcctgaagtctgctcccagccgtgcactggccgcgaattcggcgctgagagcgggagagggagagaaaaacactttgtattttccaggttgcctttgcaggcgcccgcatttctaacctgttcttcctcttggtggaaggcaaagtccagggagaggctgtccctaggcggggcgctggtggggctgggggacacaggttgcccgcctcgggggcaggagacttccagggtgagaaaaaggcagggtgccgggtggagggagtgcccgcctctgctccgtgtggacagtctagcccggagcgggtgggagcgtcgccctgcctggcgccgggtctctgcggttcggaagtgcagctctctctcttccgttcttcgtggtcagcctgggtcacacttattttatttttggaagctcgggctgacccagcgcaggaagaaagtcatcaagcggtcgcgatcattttccattacctgaaagtaggtggcaaaataggcaattttttatttccttttgttgttgttgttgctgtgttttaatttggattcttgtgtgttttttacaaagcagtttctgtgtccgtttgccccaccctagagctgaagttcttttcccctaatcctcagtctgatcacacactgttcttaatgggggtttcaaagcactttcaaaggggaggggggactgggaaagagaagaggggcggaggtagggagtccagctttgaagaaggaggccagggatcggatcggcagaaatcacttaaaaaataaaaacaaaaaagcccccttttatttcaaagatgctactttgactgcaagcaaatctgcaccgaaagtttacagctccgggagctgggtcctgcgcgcccggagtgagcagtgggaccctggaaaatgccctttttttaaaaagccatttttctttcactttaagaaatatgatatcttttttttttctctcgacccaaaaggagataggcgtgtgcagattacaggcaatgcccccttcggtcagtgcagcgtggagtcgctgtgtgtgcgtgggttggacttgtgcgtcctggctgcgtgtctcaggcagggctttcgtgctcgcagtgtcggggtgggaaacctgtgccggatgtccgaggggctttgcagaaagcctggcagtgggcggcgtgacctctgcctgggggcggagtggctccttggggctggaaggcagttctcttgagttgggggagatcttagctggggagagggaggcgggggaagtgtgctcctgcatttcgtgacacgtacccttcggaggcgcccgcggcccccgcctgtctgagtctggggatcgtaagcaggggggcagcctggcccatggacagcgtcagtccgcctggagaaactcccctggggatcggctgtgtcccacctgctggggacggtgttggggcacagagaggcgataaactaagtgaaagcaaagagcagcgttgtcttctgccattcttttggaggtgaggagatccggtttccagcactgccttgctccgaattgggagacgtttgtcacctgccttgttcgctgtggcctctattctaaagagcggagatcggataaaggtccacttttgcctgttttatactttttattgtcatataggcttgggaaagggggtgatcgttttgaaattgaagaaggactgcagtttaaggaattccttgacagaatgctagatacgaaatgtgacatttgaatttttaaaacgcttttctggttattatcacttcgtttgtgttctcaattagcagggagaacaaccttttagctgcagaatctaaggtggtgttctaggctatcagactgtaaaatagttaattcttaagttgttgagaagttgaaaataaattcatgtcttcttcttgttaagtttgctttaatgtgtttctggcacctaataggatttgatttgcttttagttctataactttgtgctactatacaattaataaaaaatggcatgattgttgtagaatttgggtatttacttttttgcatgccatattcattctacctggtttgaaaaagttacagaatgccgtatacgtcacagttaaagtgtttgatgtaaaagtaaaaattaagaaccaagaaagaatcttctaggttgcattattaacgcttaaggcaaaaatgactatgacaaatggaaacctatttcaaattttgaaaggattttcaacttttgaaaacattggtagcagtgttatattccagcaatacttccttgcgatttttacgttgaacctgaaccttacaaattgtatgtttctttgaataaggaattcttacttaagtgactcaaagatcagttttgtattgttgtacgtcacaggattacagaattgtcagtagcccgccgtaatttttacttttgggtacatgcgttgttgatcatatggctaatacctccctactgccattccatttcaaatcctgtttctctagggaaagtgggaagtgaggagtcaattcaggtgggtggagagtgggaagtatcttagagtatcaaccgttctttcctcttggcttcctcaggagttcagatgtgttctaagcctgctggagtgaccacacttccaagacctgatggaggccagagctcagagtggcaacgggtcgcagcccttgctgcagacgccccgtgacggtggcagacagcgtggggagcccgaccccagagacgccctcacccagcaggtacatgtcttgtctctggatcagatcagagccatccgaaacaccaatgagtacacagaggggcctactgtcgtcccaagacctgggctcaagcctgctcctcgcccctccactcagcacaaacacgagagactccacggtctgcctgagcaccgccagcctcctaggctccagcactcgcaggtccattcttctgcacgagcctctctgtccagatccataagcacggtcagctcagggtcgcggagcagtacgaggacaagtaccagcagcagctcctctgaacagagactgctaggatcatccttctcctccgggcctgttgctgatggcataatccgggtgcaacccaaatctgagctcaagccaggtgagcttaagccactgagcaaggaagatttgggcctgcacgcctacaggtgtgaggactgtggcaagtgcaaatgtaaggagtgcacctacccaaggcctctgccatcagactggatctgcgacaagcagtgcctttgctcggcccagaacgtgattgactatgggacttgtgtatgctgtgtgaaaggtctcttctatcactgttctaatgatgatgaggacaactgtgctgacaacccatgttcttgcagccagtctcactgttgtacacgatggtcagccatgggtgtcatgtccctctttttgccttgtttatggtgttaccttccagccaagggttgccttaaattgtgccaggggtgttatgaccgggttaacaggcctggttgccgctgtaaaaactcaaacacagtttgctgcaaagttcccactgtcccccctaggaactttgaaaaaccaacatagcatcattaatcaggaatattacagtaatgaggattttttctgtctttttttaatacacatatgcaaccaactaaacagttataatcttggcactgttaatagaaagttgggatagtctttgctgtttgcggtgaaatgctttttgtccatgtgccgttttaactgatatgcttgttagaactcagctaatggagctcaaagtatgagatacagaacttggtgacccatgtattgcataagctaaagcaacacagacactcctaggcaaagtttttgtttgtgaatagtacttgcaaaacttgtaaattagcagatgacttttttccattgttttctccagagagaatgtgctatatttttgtatatacaataatatttgcaactgtgaaaaacaagttgtgccatactacatggcacagacacaaaatattatactaatatgttgtacattcggaagaatgtgaatcaatcagtatgtttttagattgtattttgccttacagaaagcctttattgtaagactctgatttccctttggacttcatgtatattgtacagttacagtaaaattcaacctttattttctaattttttcaacatattgtttagtgtaaagaatatttatttgaagttttattattttataaaaaagaatatttattttaagaggcatcttacaaattttgccccttttatgaggatgtgatagttgctgcaaatgaggggttacagatgcatatgtccaatataaaatagaaaatatattaacgtttgaaattaaa

SEQ ID NO: 12895 - DNA, 400 bp, Homo sapiens
tacaaggagtgagaggtctggtttccatggggacaggatgccagtgaaaagggactgaagtggaggaggaacagagacagggaggccatgaggagctcctgcaacagtccatgcatgagaggacagaggcttgcactagtggcagcagtgcaggtggaacagagggacttgggagacctttgggaggcttggccaacaagacccactgacagatcaaacacagggaatgagagaagaggccaaagacggctgatggtgcagtttctggcctgagtcactggatgttttgcaactgaggccaacactgaccaccagacactgtccccttcttcctcactaacaagctactattttgttcaggatccctccataaaacctagtgttcaagcaggggcccctc

SEQ ID NO: 12896 - DNA, 546 bp, Homo sapiens
ttttttgagacagagtctcgctttgtcacctaggctggagtgcaatggtgcgatcttgggtcactgcaacctccgcctcctggattcaagcgattctcccgcctcagcctcctgagtagctgggattacaggtgtgcaccaccacacccggctaatttttgtatttttagtagaaatggggtttcaccatgttggccaagctggtctcaaactcctgacctcagatgatccacccacttcagcctcccaaagtgctacgattacaggcatgagccactgcgcctggcccgcactgacttttagttaataggatgcacacttcctatgtgcagacatggtgctcagtgctttacacgtggtgacacacttaacaatggcatcgccttctaagggagagaggacaattactgtccccttatacagaggagaggagaggcagagaaggggtcagtcctcagccttctctacttagttctcttagactgatgctcccaagcactgacaaagaagtgggaggggttggtcagctcacgataggggcctaag

SEQ ID NO: 12897 - DNA, 38771 bp, Homo sapiens; identical to SEQ ID NO: 12795
  misc_feature (29356)..(30880): n equals a,t,g, or c

SEQ ID NO: 12898 - DNA, 1782 bp, Homo sapiens
ccgttgcccaggctggagtgcagtggcgtgatcttggctcactgcaacctctgcctcccaggttcaagctattctccagcctcaaccttccaagtaactgggattacaggcatgcaccaccacacccggctagtttttgtatttttagtagagatggggtttcaccatgttggccaggctggtctcgaactcctgacctcaagtgatctgcccgccttggcctcccaaagtgctggaattacaggcgtgagccactgcgcccagcttccatttcttctttgaaaagtaggaggggttggaattgtcaccctggaggttcatggttgctagattattgattctgttgctggattcaggagacctgttagctggctagttcacagcaagtattgggtgtttggaggggggctgcagagccccttctcaggccccaggagggccagctgccctccctaccccctcttttggacactagtgggcatgttctgctgggaaaacagacagtgtaacctgacttcgagggctgcaggctgaatctctttcagatgtactggctccttgagaggcctagcagatctctactctgtgggtccctttcggagctggggctcaggtttgacccagccactctgaccggagacagcgcagaaatcaccaggagcatttgtttgttttcctttgctgtccagacagtggcccaccgtctgcttcagtctgagcgtggccctgcactagtgagactgatgtggccacaggttcagagaatcagtgcgcctgagtgggagagcagagcgggaggggatttggaggcaggcgggctgtggacagggaggggggaggacatcttccgagctgtcagcgggaggccttcttgaaggtctttcaggagcaaggccagaggccgtgggagtgggcggggcctggggctgggagtcaggggtctgaggcctcatcttggcccggcctctgcttccgggagaacttggccaattcccttctcctttctgaaccttggtggccccagctgtcacttgagattagcaaggacctccctggtcccagcaggagtgagtggctttgggcagggggtggagtgcagattgcactgccacgtcacccagctcagaaggcccaggtgtggtccagctgtggacttgattgtgaactcctggggaagggctctggtcctttgcctcagttagcgggacccccaccagtgccctgggtgcccctgctggcccctcctctcgctgaccccagccccagtttctggctgcaactcacagaggccccaggctcctgtggccccatcaccagcagctcctgctgtcatttcctgagcctcgcaagcccctaatcctgctccttcctgtcctggcccccagctccctcaagccccactcctgcatcccattctccctggacatcacccctcccaccccttggctcaatttccttcctgtcgtggcttggtcctttggtcattgccctggtcttttcttgtccccttcctgattctgcccttctccaggcccacacggggaacctcctaaccgctgagccctgaaaggtaggcgggtttaggatgagtggctacagggaggagaatggtgtggggagagagatatggaggaaagaatattaggggacaggccgggcacggtggctcacgcctgtaatcccagcactttgggaggccaaggcgggcggatcacttgaggtcaggagttggagaccaccctggccaacatggtgaaaccctgtctctactgaaaaaaaaaa

SEQ ID NO: 12899 - DNA, 1782 bp, Homo sapiens
ccgttgcccaggctggagtgcagtggcgtgatcttggctcactgcaacctctgcctcccaggttcaagctattctccagcctcaaccttccaagtaactgggattacaggcatgcaccaccacacccggctagtttttgtatttttagtagagatggggtttcaccatgttggccaggctggtctcgaactcctgacctcaagtgatctgcccgccttggcctcccaaagtgctggaattacaggcgtgagccactgcgcccagcttccatttcttctttgaagagtaggaggggttggaattgtcaccctggaggttcatggttgctagattattgattctgttgctggattcaggagacctgttagctggctagttcacagcaagtattgggtgtttggaggggggctgcagagccccttctcaggacccaggagggccagctgccctccctaccccctcttttggacactagtgggcatgttctgctgggaaaacagacagtgtaacctgacttcgagggctgcaggctgaatctctttcagacgtactggctccttgagaggcctagcagatctctactctgtgggtccctttcggagctggggctcaggtttgacccagccactctgaccggagacagcgcagaaatcaccaggagcatttgtttgttttcctttgctgtccagacagtggcccaccgtctgcttcagtctgagcgtggccctgcactagtgagactgatgtggccacaggttcagagaatcagtgcgcctgagtgggagagcagagcgggaggggatttggaggcaggcgggctgtggacagggaggggggaggacatcttccgagctgtcagcgggaggccttcttgaaggtctttcaggagcaaggccagaggccgtgggagtgggcggggcctggggctgggagtcaggggtctgaggcctcatcttggcccggcctctgcttccgggagaacttggccaattcccttctcctttctgaaccttggtggccccagctgtcacttgagattagcaaggacctccctggtcccagcaggagtgagtggctttgggcagggggtggagtgcagattgcactgccacgtcacccagctcagaaggcccaggtgtggtccagctgtggacttgattgtgaactcctggggaagggctctggtcctttgcctcagttagcgggacccccaccagtgccctgggtgcccctgctggcccctcctctcgctgaccccagccccagtttctggctgcaactcacagaggccccaggctcctgtggccccatcaccagcagctcctgctgtcatttcctgagcctcgcaagcccctaatcctgctccttcctgtcctggcccccagctccctcaagccccactcctgcatcccattctccctggacatcacccctcccaccccttggctcaatttccttcctgtcgtggcttggtcctttggtcattgccctggtcttttcttgtccccttcctgattctgcccttctccaggcccacacggggaacctcctaaccgctgagccctgaaaggtaggcgggtttaggatgagtggctacagggaggagaatggtgtggggagagagatatggaggaaagaatattaggggacaggccgggcacggtggctcacgcctgtaatcccagcactttgggaggccaaggcgggcggatcacttgaggtcaggagttggagaccaccctggccaacatggtgaaaccctgtctctactgaaaaaaaaaa

SEQ ID NO: 12900 - DNA, 1782 bp, Homo sapiens; identical to SEQ ID NO: 12898

SEQ ID NO: 12901 - DNA, 5775 bp, Homo sapiens; identical to SEQ ID NO: 12799

SEQ ID NO: 12902 - DNA, 738 bp, Homo sapiens; identical to SEQ ID NO: 12800

SEQ ID NO: 12903 - DNA, 410 bp, Homo sapiens
gctggagccaaaggtttgttggggacagtgacagcagcacacgaggctgtaagtttagggccagtttatggaggagtagtaccaattacattgagaaaactgtagcaactataatttgggaggaattttctaaatactttacatgtgttatttaatcttcccatcagccccaggaggtatgtgcatttatcagtcccattctacagatgaaaagactgaggtctatgaactcctttatttaaaaacaaaacaaaaccccctcaaggctgcctgctaagaggggaggagtgtggattcaagccagcatccttattccagtgtccatgctctcagccaccacacacacactcctatcaggagttggggcagtggggagccattatagtttttgagcaagagagtgacagggc

SEQ ID NO: 12904 - DNA, 410 bp, Homo sapiens; identical to SEQ ID NO: 12903

SEQ ID NO: 12905 - DNA, 513 bp, Homo sapiens
ggtggattgatttcctgactcaggctccagggccatcaagaattcacggctgcctttcagccttcatgaaggacatggtggagctccttaggcagaactggggtttgtggatgtcctgcctctctgccccttggtacctaggtggcaccttttcaagttcgggagctagatcctttccccttccccacactgtaggaaagtccttactgtaggcaggcgctgcagagcctgctgtctgggaacccacaggttcaaggaagccttgagcaggaagggcgttttcctggaagaagccctttgtcgccggtaatgggtgcaggctgctctgacccggttctgagtcctgcccccttccaggcctagggctttgggccttgatcacctctgctgagtagctgactgcggggctggggctctgatgctcaggacccacctctctgggacccacagtctttttccactgtggcgtgtagtgatgtcacaggtggcagtgatgtcactgtggtttgaggt

SEQ ID NO: 12906 - DNA, 513 bp, Homo sapiens
ggtggattgatttcctgactcaggctccagggccatcaagaattcacggctgcctttcagccttcatgaaggacatggtggagctccttaggcagaactggggtttgtggatgtcctgcctctctgccccttggtacctaggtggcaccttttcaagttcgggagctagatcctttccccttccccacactgtaggaaagtccttactgtaggcaggcgctgcagagcctgctgtctgggaacccacaggttcaaggaagccttgagcaggaagggcgttttcctggaagaagccctttgtcgctggtaatgggtgcaggctgctctgacccggttctgagtcctgcccccttccaggcctagggctttgggccttgatcacctctgctgagtagctgactgcggggctggggctctgatgctcaggacccacctctctgggacccacagtctttttccactgtggcgtgtagtgatgtcacaggtggcagtgatgtcactgtggtttgaggt

SEQ ID NO: 12907 - DNA, 410 bp, Homo sapiens; identical to SEQ ID NO: 12903

SEQ ID NO: 12908 - DNA, 9147 bp, Homo sapiens
gaaatgtctgatgtaattcttatccttgttcctcaataggtaaggtttctcttaactaccatctgtggcttctttaagtatctttttgttgtctttgattttctgcagattgaatatgacatgcctaagtgtagatttttggtatttatcttatgtcatgttctccaaactttctgcctctgtgatttggtgtctgtcataaatgttggaaagttttcagccattttttcttcgattactattttaatgatttttcagctttacaatggtgcaaaagcaatatgcattcagtagaaaccatacttctcttgctatgctgggcagcagcaagcctcagcttccagtcagctatgcctttttgactgacagtattttcactcaggatggacttactgggacttaagtggaggagcatctgtattctgtttccttctctctttcttttctgtcttggattcctattatgcatacattttacctttttaaattgtcctacagtcttaggatattctattccttttttttttctttgcttttcagttttggaagtttttattgacgtatctttgagctcactgattcttaggccatgtgcagatgatctggtaatatgcattctttttttctgttgctgtttttttttatttctggcatttccttttgattctcagaattttcatctctttgcttatattacccatcaattcttaacatgttctctactttttccactagagcccttagcatgttagtagttatttgcaattgttggcctaataattgcaaaatatctgccatatctgaatctgattctgacacttgctttggatcctcagactgttttatttttcctaaccttttagcatgtctaatggtgttttttgtttgtttgtttgtttgtttttgagacagggtctcactctgttatccaggctggagtacagtggcacagtcttggctaactgcaacctccacttcccggtctcaagagattctccagcctcagcctcgtgaggagctgggactgcaggcgcaagccaccaacacctggctaatttttctatttttgtagagatgggtttttgccatgttgtccagactaggttcaaactcctgagatcaaggcagtccgctcaccttagcctcccaaaatgctgggattacaggtgtgaaccactgagcctggctattttttttttttttttttttttgttaaaagctagatatgatgtattgggtaaaaggaactaagatcagtaggacttgagtatgaagtttcatgtttatctggctaggggttaatctgtgtttatttgctgttgatgtcagaggctagaatttcctatagtgtccttgatcttgtctactctgtggtatttgggtttccctagagactcccttttatttttacttttttagagacagggtcttgctgtgttacccaggctagagtgcagtggcacgatcatggcttactgcagccttcaactcctgggttcaagggatcctcctgcctcaggctcttgagaagatggtactacaggcatgcgcctccatgcttggctaatttatcttttgatttttgtagaggtgggggctcactgtgttgctaggctggtcttgaattcctgggctcaagtgatcctcctgcctcggtttcccaaagtgctgtgattacaggcatgagactcctttttaaatagagcctgagccttaccattctttcagttgtgatttcctgttttacaggagctctgttgattgtagtaagatgagtgttgtggagcggggagaatagtctgtatgtagtcctgtgattaggctcaggttttttgtgggacagtgcccctgggctttcacctttacaaatgcttctcagcttttttaccccccttaggtggaacaagaaagctagagagagaaccctagttggatattttccttattccacttggtcaggctttgatatacccgctgttggttagcctctggtaaaataattttccttaaggtcagtcctttgttaaggataacagaatgttctgggaatatttgaatatggttactttttccttttttcctttctccttccagaagcacagggatttttttctcttttctttaccctgacaacctgatggggcttttggagttaaaaatcatggaagtagctgggcacggtggctcacgcctgtaatcccagcacttgggaggcctaggcagatggattacttgaagtcaggggtttgagaccagcctagccaacatggtgaaacctcatctcttctaaaataatacaaaaattagctgggcatggcgggtgctgttaatactcaggaggctgaggcaggagaattgcttgaatccgggaagcggaggttgcagtgagccaagatcgcgccattgcactctagcctgggtgacaagagtgaaactccatctcaaacaaacaaacaaaaaaaatcatggaagtgtggggagccccttaaggctggtttgccaggagtttccatctgtcaaactagtccatatttagactgtcttaattaatctatttaagtttttcttccagttgttggcttcagcaatagttgctgcttctggtaagctgtgattttctgtatttgcttgtttctttagttttggaggaggcagcagattgtcctgtgatctcggttctctgatggatctaagagaagctactgatttccagttcagtttttttttttttctgttgtgtggacaggagtgacagcttcactagttgaactcaaaactggaagtagtatgaatttttcagtgtctgaatttgccttcaatttagtttgagtcccacgacttagaagtaggctgttctactaggagctttttaaaccattacagttatttaatttgattcatttaatctctattgaggatctactaagtttcatgcatcttttattatgtatagtatttcatgcactggaaatattaagatgcttctatccccatacttcttttttcaaaggctttttctcattgttctctagaggatgggtctatctcttatattttgctaaagatttgttgccttttgtattttatctttccttctattagcaaatgtttttctctattagctcattctcatgagtatctaattatgctttcatacatcatcttaaggaagccaccttgggtctttccacaccccctaacttctgcaatctctgttcactttcattatcaagagttgtctacttatattgttacaatctctcaaatttagtttacttttcaatctattccattctggttgtcgcttctgataccactgtgaatgctctgtcatcagggtcctccctgttgcaaaatccttcttctctgcgtgccacatactcctacctccccacctcaggctctggcagccacagatcttactatctgtctagttttgcctttcctggaatgtcatagtgttggagtcatgcagtgtgtagctttttcagactggctttcacttagcaatatgaaagtttttttcatgtctttttgtgacttgggagctcatttcttattattgtatatatctaccacagtttgtttatccatcatctaatgaaggacagcttggttgcttgatgtttttggcagttctgaataaagctgccgcaaacattcctgtgcaggtttttatgtggacttgttttcaactcatttgggaaaatacctgtgtgtgcaattgctgagtcatgtagtaagcctgtgcttagctctgtaagagactgcagactgtctcaactcgactgtactgtttttgcatttccaccagcaatgaatatgaattcatttgctctgcattcttagcagcatttggtgttgtcagtgattgtagcctgtctaataggggtgtggtagtatccattgttttaattagcatttctctagtgatatagggtgttgagctccatttcatgttttttttttttctctattatctttggtgatacatctgctcagattttttgctcttttttaagattttttctttattgtgtgttaagagttcttggtatattttagataccagtcctttataagatgtgtttgacaaatattttctcctagtctgtggcttgtcttttcattttttttaaacagtgttttacagagaagaaaaattttcaattttaatgaagtctaccttatcaattttttctttatgggtcatgattttcgtgctgtgtttacaaatatattgccaaacaagattttcttcctcattatctacaagttttacagttttgaattgtatgtataggtctgtgatactttctgagttaacttttgtgaaagataaaaggtcagtgttggatagattatttttccttttgcatgtggttgtccagcaccatgaagactcttccttctccactgaattgtctttgtacttttgccaaagatcagatttacctcttaaatctttgtcaaacctgtccacttctcaccatctccattttcaatctcttcaagccaccatcctctcttgcctaattattgcagtagtccttactggtcttgccttatctgttgatccctgttttattcacagaatatgatttgtgattttaaaggcataaataaaatgccttttctgtttaatatctaattgctttcctttatacaaacaacaaaatccaaattctttatcatggcctgtgagaccctaaatgatcaggccctaccttttcttccaactttaccctcattcttcctctccagccacctttggctcatttagtctctgaatgtgttactgtctactaccttaggggattcctaatgactggaatgccccttttaagtctcagcttaaatgtttcctcttcagggatgccttttctagtcattatatctaaacatttagttctcttccttgacttttactctctaacattacatcaattctttactactattttgcccaatttaaaagcatatattgttggtctatttattgtctgacttcctgagaccagggatcacgtctgtcttgtttgctattgttttttttagcagctgctacacagtaggcgccaaacaaatattttaaggaagaagacataggcagcctttgagatgcccaaatttagtgaggaagatccatatgtatgtaggtaaattatagtgccattttagtgctgttagaaagttgtagttttggaaaacaagtaatgaaaggttaagaaagaaaaatctttcggattcttcctcaagtgtgtgaactttatagctgtcaatttatgaagtcttattgcctaggtttctttttttttttttttccattctttgtcacttttattcagtaggttttttttcccttattttcagtgccagacatggcgaggagtgattacagccaactgttattaaaacatttgttcacaacatataccccctttataccactgaccccaaactgactcattttatgtgctttcattctttctttttttaatataccactatcaagaccgggtggagggggcaagggtaagagagatgaaggggaggagtccaggaggccagaagaggggaatgctacaagccacagtaagaatgagctgtatttaatttaaaaaaaagggggaaggggtgtaccccacaaatgatacagtaatgaggatacacaattaaatcccatagcatgactgaaagctttcactgtgtttgacatcatcacaatggaattgcctaggtttcttagctaaaagtaagtttgtatcttttattatttgatagtggggggttagcgtcctagaagtcccagacttaggttctcaattgtcttaagaaaccatccatctgtattgacaatatgggtgctctaggggcagtcttaagcccaataagaggtcttttagcgcactgagcttttgctctctagggtcagtgtttggatttgaatatccagcactgccactcaccttgggcaagtcatttaaactgcatgtctcagtttcctcatctgcaaagggactaataaacacacctacctcctgggatggttttgaggaatacattggctaatatatgtaaagcatttactatgtgccagaccctgcaataaatgtgaaagtagtctctgttactacataaagggcttctcatttagccaaaattttattacattctagtacacttacgttgagtaatatgcagctttttcagtggatacttcatttcaaccttacagagaaattagaaaccatcagatgggatatccttcattctgataccaaacataaatctgacatgttcaacaccccttccttcagcttcacctatgctctatatcttatcacctctgctatctgagatcttaagatttttaaaaaattacttctttctcatatttaactttttcctttcaactagatccttctcttatgcatagaagcatgttaaagtttgtctaaaactttcattgatttatatctagctacttccccatgcttcctctgcatacccaaacttaaaaactctgtaatctctccattcctcccctactcagcccacttgaatcttgcttccacctctgataacctcactgaaataatactattgaggttattagtagatcaagtggacagctttgtatctagtcatatgtgtaccctcagcagcatttgaaacagtagactacattctctcttcacactttgggtgctattaatctttagtcctctgatttcctgtctttctggccagtttttagtctgattcgcagactcattctcactctacctggactttatatatgggagtttcttaggcagggtccttggttatcatgtgtcaattctctgggcatttctaccaataccacagattgaataccttcacacagatgactcgtgtttataacactgatcaacttcatagatctacctatttgacttctctttttgggtgtcccaggagcacttcaaacatgctttatgaatttatgatcttcgccttcaaatctggttttcttttgggagatctcatcttagtgactgtcacccacatgtgttcagttatgtatgctggaaacctgggtgtcgtatttcagtatatctgtagtccttacaccataatccatcatctagtcctgttggtttttttacgggctggagggctgaaatatctcagccatatatcctgttgtcattaccttgtctcaatccatgatttcctaacttggatgcaagagttctaattggtctccttgtatataaccttatgctaatgaaattcattctccagaatttggctggagtgatgttattcctttaattaaaacattatattggcttccaattaattttgggattcatgggtagggtagagacaaaaattcttgctataatttttgaaaacctgagagtcgccatttacctttccagtcttacctttgaccactttttggctgtctcttttgcccatttacttacttcagggacgtctcttgtgatgttcttgaataggtgagatcattctgtttgctgtcattgtgccatgtatactccattttgtatactcctggttttacatttttgcgtgccatttctccctgtagctaaaatcctgtgagagaccaggatcttgtttacttttgcttaccatttgccattgcttattagcatagctaattggcttatacccttcatacattgaattttaagatgtcagccttatttttcatttactatgaaaaaaagggaaggaaagtaatcagtgaaagaagaaacctaacatgatagatgtaaaacatactgctttgaatcaatgaaagataagatcacaatgatattgttgaaatcattttctgtaaaagctgaactaacttaaactataacatcctctcccagccccttgcttttctataatggtaaaataaatgctattgaagaaaaaaaatttagaccggttctagattctaacaccttaagaaaataattggcactaaatccactgtttcaggcctttcaaaactgaaaaattacattgtgtttctaacattgaaaataaagtttcaagatagttttaattaatttggatataagtatagaaggtttgaccactttcagaactctcaggtgattttgacttgtgatcatctctgggaagggatatttagtgatagcctgaattttaaaaacctcaacttgaacactgggagttgatgggagaccatctgattaagggatggactaagtaagtgtaccagtgtcagtttgcctattaaatacaatcaaagcgcaatgtctttccttttaagataaaaaaccagtaatttggataatattttaattcagcaccaagtagattgtttctcacacctgtgttggaagttactggtttagagtatggtttaaatttttttctctcataggcctttaaaattaaaataatttgcatgttaattaaattccagccttaatagggttttccatcaccttaattcccacatttgtttttcatttccaacatctttgaacttttattgaataaaataattgtacaatcttagataaatattaaaccaaaatttgatgaaagtaatactgcattcatgatactttgctagctagatactataattagaactgaatgaaataaacaacctgtttttaatttttcccttttttgagggatgacacagtttgcctaattagaaataccttttgtgactgtcgtttgtttacctctattttgcagcagcatagcacttctgagatgtttaacttcttttttcatcaaaattattttgaacatgctgacatatctttgagatttaattcctagtcatttaaagaaaataaggggctaggggtggtggctcacttctgtaatcccaacacttggaggccaacgctggaggatcacttgagtccaggagtttgagaccagcctggacaacatagagacctgtctctacaaaaaaaaaaaaagttagctgggcgtggtggtgcacgtctatagccccagctactctggaggctaaggtgagaggattgcttgagcctgggaggtccgtgtctgcagtgagctgtgatcctgccaatgcactcagcctcggctcagtgagaccttgttaaaaaaaaaaaaaaaaaaaaa

SEQ ID NO: 12909 - DNA, 332 bp, Homo sapiens
ttttcatttagtttgaaacaattaaaaaaattgaggcttctttgaccgatgttatatttagaagtgtatttttaaatttctaagtattttgtgggtttgcaactatctgtaaatatttggtatgtgttattgatttttagtttaattccattgtgggctgaaagcttggtttgtattcttttacatttgttttatgtttttattgcccagaatgtggtctgttttggtgaacatttatgtgagcttgagaagaatgtgtattctgtttgttgttggatgaagtagcctatagatgtcaattagatcctgttgattgatggtgctgtttagtt

SEQ ID NO: 12910 - DNA, 621 bp, Homo sapiens
gcgatctcggctcactgcaacctctgtctcctgggtttaagcgattctcctgcctcagcctcccaagtaggtgggactacaggtgtgtgccaccacgccctgctaattctttttgtatttttagtagagacggggattcaccatattggtcagtctggtctcaaactcctgacctctggtgatccacctacctcagcctcccaaagtgctgggattacaggcatgagccacagtgccctgccagttttgtttattttgttactgctttttcctctccctctggaaccactagattgtgagtcatgcacagcgtgtgtgtctctctcatgcccgctatatagtcacagcagctgttctttgattcatttgttcattcaacatatatactttgagaggctggcacaatgccaggcactaagtttgatagtggagacacacaaattaaaaagagattcatatcctgacctcaagttgatgacaatttagaagggctatgcgtaggaaaacagaaaactataagcaatagactcagtgtcacggtccagatatatccaagacacttggagcacagagggagtcctgctccaagggagtcttacgtcttttattagccatagatag

SEQ ID NO: 12911 - DNA, 640 bp, Homo sapiens; identical to SEQ ID NO: 11932

SEQ ID NO: 12912 - DNA, 606 bp, Homo sapiens; identical to SEQ ID NO: 11933

SEQ ID NO: 12913 - DNA, 628 bp, Homo sapiens; identical to SEQ ID NO: 11934

SEQ ID NO: 12914 - DNA, 1329 bp, Homo sapiens
ttttttttttttttgagatagagtctcgccctgtcacccaggctggagtgcagtggtgcgatcttggctcactgcaacttctgcctcctgggttgaagcgattctcctgcctcagcctccggagttgctgggattacaggtgcacgctgccatgcctggttaattttttttatctttaatagagacggggtttcaccatgttggccaggctggtcttgaactcctgacctcatgatccacccacctcggcttcccaaagtgctgcaattacaggcatgagccactgcgcctggccacctttgctgatttttataaccagggttcagtgggcaacagcaaccaagtgtcagtttacagccaaatcagggattggactgactcaaggctgcagttcagtatttgtaaaactaggtctatttctgatttgtccctatgattgggaatagctcttgatttggcaagtgaaagcctaggtgttttctagattacctcctgctcagcatggtgagattgtggaagctctgcttaagccagcttcttatcaaatgctttctgcttggtttagcagcctgactacgtgctacttatgcatagataaatgttttgagaagaaaaatatctcctattattatactcacttctttgtgctgccttctctcttaatccctctctcctttggtaaccctaagctccaattatgcccaaacctctgcttagccaccactttctgcttggcattttaatgtctcatcctaaactgattataagccagcaaattccttgagaaggaaaggagcatagaatgtcaggctaggctcacctcagtgagtttccttttctctcagacaccttacttggcccctcaagtcctggcttccattggtaacactctaatgctttcaaccattcttaaaattaagcttttctgttgtttgtttgttagtaggaggtttggtctgttgtaaattagtctgatgcaactgacacagctgaaagtaaagtcagttgtttctcttaaaaaatccacataatggccaggcgcggtggctcacgcctgtaatcccagcactttgggaggccgaggcaggtggatcacaaggtcaggagatcaagaccatcctggctaacatggtgaaaccctgtctctactaaaaacacaaaaacttagctgggcgtggtggccggtgcctgtagtcccagcgactcgggaggctgaagcaggagaatggcgtgaacccaggaggcggagcttgcagtgagccaagatcgcgccactgcactccagcctgggtgacagagcaagactccatctcaaaaaaaaaaaaaaaa

SEQ ID NO: 12915 - DNA, 640 bp, Homo sapiens; identical to SEQ ID NO: 11932

SEQ ID NO: 12916 - DNA, 513 bp, Homo sapiens; identical to SEQ ID NO: 11936

SEQ ID NO: 12917 - DNA, 612 bp, Homo sapiens; identical to SEQ ID NO: 11937

SEQ ID NO: 12918 - DNA, 462 bp, Homo sapiens; identical to SEQ ID NO: 11938

SEQ ID NO: 12919 - DNA, 640 bp, Homo sapiens; identical to SEQ ID NO: 11932

SEQ ID NO: 12920 - DNA, 640 bp, Homo sapiens; identical to SEQ ID NO: 11932

SEQ ID NO: 12921 - DNA, 654 bp, Homo sapiens; identical to SEQ ID NO: 11941

SEQ ID NO: 12922 - DNA, 647 bp, Homo sapiens; identical to SEQ ID NO: 11943
  misc_feature (29)..(29): n equals a,t,g, or c

SEQ ID NO: 12923 - DNA, 1229 bp, Homo sapiens
gattctcctgcctcagcctccggagttgctgggattacaggtgcacgctgccatgcctggttaattttttttatctttaatagagacggggtttcaccatgttggccaggctggtcttgaactcctgacctcatgatccacccacctcggcttcccaaagtgctgcaattacaggcatgagccactgcgcctggccacctttgctgatttttataaccagggttcagtgggcaacagcaaccaagtgtcagtttacagccaaatcagggattggactgactcaaggctgcagttcagtatttgtaaaactaggtctatttctgatttgtccctatgattgggaatagctcttgatttggcaagtgaaagcctaggtgttttctagattacctcctgctcagcatggtgagattgtggaagctctgcttaagccagcttcttatcaaatgctttctgcttggtttagcagcctgactacgtgctacttatgcatagataaatgttttgagaagaaaaatatctcctattattatactcacttctttgtgctgccttctctcttaatccctctctcctttggtaaccctaagctccaattatgcccaaacctctgcttagccaccactttctgcttggcattttaatgtctcatcctaaactgattataagccagcaaattccttgagaaggaaaggagcatagaatgtcaggctaggctcacctcagtgagtttccttttctctcagacaccttacttggcccctcaagtcctggcttccattggtaacactctaatgctttcaaccattcttaaaattaagcttttctgttgtttgtttgttagtaggaggtttggtctgttgtaaattagtctgatgcaactgacacagctgaaagtaaagtcagttgtttctcttaaaaaatccacataatggccaggcgcggtggctcacgcctgtaatcccagcactttgggaggccgaggcaggtggatcacaaggtcaggagatcaagaccatcctggctaacatggtgaaaccctgtctctactaaaaacacaaaaaattagctgggcgtggtggccggtgcctgtagtcccagcgactcgggaggctgaagcaggagaatggcgtgaacccaggaggcggagcttgcagtgagccaagatcgcgccactgcactccagcctgggtgacagagcaagactccatctcaaaaaaaaaaaaaaa

SEQ ID NO: 12924 - DNA, 640 bp, Homo sapiens; identical to SEQ ID NO: 11944

SEQ ID NO: 12925 - DNA, 640 bp, Homo sapiens; identical to SEQ ID NO: 11945

SEQ ID NO: 12926 - DNA, 571 bp, Homo sapiens; identical to SEQ ID NO: 11946

SEQ ID NO: 12927 - DNA, 640 bp, Homo sapiens; identical to SEQ ID NO: 11932

SEQ ID NO: 12928 - DNA, 639 bp, Homo sapiens; identical to SEQ ID NO: 11948
  misc_feature (88)..(88): n equals a,t,g, or c

SEQ ID NO: 12929 - DNA, 648 bp, Homo sapiens; identical to SEQ ID NO: 11949

SEQ ID NO: 12930 - DNA, 434 bp, Homo sapiens; identical to SEQ ID NO: 11950

SEQ ID NO: 12931 - DNA, 624 bp, Homo sapiens; identical to SEQ ID NO: 11951

SEQ ID NO: 12932 - DNA, 509 bp, Homo sapiens; identical to SEQ ID NO: 11952

SEQ ID NO: 12933 - DNA, 654 bp, Homo sapiens; identical to SEQ ID NO: 11953

SEQ ID NO: 12934 - DNA, 546 bp, Homo sapiens; identical to SEQ ID NO: 11954
  misc_feature (20)..(20): n equals a,t,g, or c

SEQ ID NO: 12935 - DNA, 654 bp, Homo sapiens; identical to SEQ ID NO: 11941

SEQ ID NO: 12936 - DNA, 3904 bp, Homo sapiens
ccatctcccagaagcctgctttttaatgcccgcttaatattatcagagccgagcctggaatcaaactgcctctttcaaaacctgccactatatcctggctttgtgacctcagccaagttgcttgactattctcagtctcagtttctgcacctgtcaaatagggtttatgttaacctaactttcagggctgtcaggattaaatgagcatgaaccacataaaatgtttggtgtatagtaagtgtacagtaaatacttccattatcagtccctgcaattctatttttcttccttctctacacagcccctgtctggctttaaaatgtcctgccctgctttttatgagtggatacccccagccctatgtggattagcaagttaagtaatgacactcagagacagttccatctttgtccataacttgctctgtgatccagtgtgcatcactcaaacagactatctcttttctcctacaaaacagacagctgcctctcagataatgttgggggcataggaggaatgggaagcccgctaagagaacagaagtcaaaaacagttgggttctagatgggaggaggtgtgcgtgcacatgtatgtttgtgtttcaggtcttggaatctcagcaggtcagtcacattgcagtgtgtcgcttcacctggctccctcttttaaagattttccttccctctttccaactccctgggtcctggatcctccaacagtgtcagggttagatgccttttatgggccacttgcattagtgtcctgatagaggcttaatcactgctcagaaactgccttctgcccactggcaaagggaggcaggggaaatacatgattctaattaatggtccaggcagagaggacactcagaatttcaggactgaagagtatacatgtgtgtgatggtaaatgggcaaaaatcatcccttggcttctcatgcataatgcatgggcacacagactcaaaccctctctcacacacatacacatatacattgttattccacacacaaggcataatcccagtgtccagtgcacatgcatacacgcacacattcccttcctaggccactgtattgctttcctagggcatcttcttataagacaccagtcgtataaggagcccaccccactcatctgagcttatcaaccaattacattaggaaagactgtatttcctagtaaggtcacattcagtagtactgagggttgggacttcaacacagctttttgggggatcataattcaacccatgacagccactgagattattatatctccagagaataaatgtgtggagttaaaaggaagatacatgtggtacaaggggtggtaaggcaagggtaaaaggggagggaggggattgaactagacacacacagacacatgagcaggactttggggagtgtgttttatatctgtcagatgcctagaacagcacctgaaatatgggactcaatcattttagtccccttctttctataagtgtgtgtgtgtggatatgtgtgctagatgttcttgctgtgttaggaggtgataaacatttgtccatgttatataggtggaaagggtcagactactaaattgtgaagacatcatctgtctgcatttattgagaatgtgaatatgaaacaagctgcaagtattctataaatgttcactgttattagatattgtatgtctttgtgtccttttattcatgaattcttgcacattatgaagaaagagtccatgtggtcagtgtcttacccggtgtagggtaaatgcacctgatagcaataacttaagcacacctttataatgaccctatatggcagatgctcctgaatgtgtgtttcgagctagaaaatccgggagtggccaatcggagattcgtttcttatctataatagacatctgagcccctggcccatcccatgaaacccaggctgtagagaggattgaggccttaagttttgggttaaatgacagttgccaggtgtcgctcattagggaaaggggttaagtgaaaatgctgtataaactgcatgatgtttgcaggcagttgtggttttcctgcccagcctgccaccaccgggccatgcggatatgttgtccagcccaacaccacaggaccatttctgtatgtaagacaattctatccagcccgccacctctggactccctcccctgtatgtaagccctcaataaaaccccacgtctcttttgctggctctgggtctctttggcgtcttgaaccttatgccttccctattgaagttaataggggttcagcacaacactgggtcccaggcatgcagccttgtctttttatgtttgtcctcatgggcatcatgtgggccacagggatcttacccaaaatcatgcctagcaggaagagatgcctctctattgatattccagctgccccacaagcaggtatgtgcctactcattctctgacatgtgtcctaggtttcttgactgtaaaattccgcttaataaataatgtattgagcacctgctatatccagagctctgctgggcactctggaagattagagtttgaagaacacacaatcgttgtcctccagaagttcatggtccagtagggagagaaggtcacaaacagccagaatctacaagatgagaggggctataaaagagagctgagaagagtttcagagccactgagaagatactcattttagtcttggtaacgggaagctttctggagttggtggcatttaagatgaaccacaaatggagcaggaatttaatgaagaggaaaggaccaggacgttcaaatagaggacacagcagagttcagaccagatgcaggaaagggtaagtggtttggtttgctgtgaggtcaggtgcatgatggaaaatggtgagcagttagatgacaaagataggttagggcagttatggtgggagaaaccctgtttttgaagaaagatacagtcagatgggcacttcagcagcattattctgacagcaatgtgcaaataggatggagaggcactgaagaggcaggatgcaaggagaacaattcagacgcagttgacatcgcttgggagagaatgaggtactatccaggacagccccaagagagtggagagccctgtcctgagattcttgggaaaaggtgccccagtatcaacagcatgtgcccataagctccctcagcccacttgtcaggctgggtcagcttgtcccccaccccaccccagctctctcctctcctctcagagcaagccacctgccctactcactgctccaccatgatacacctgtcctgcctcagccacgtccccctctgaccatttcccccttttcaggaaagtgcttgcagtttgctacctcccattctttgcagcctccttccgcaaagctctcaccttgtgtcatctttgcctgtgtgccctatggagaaggaaaacaaagtaagcgctgtcttcccagggctgcaggcgtgctggcccccaccttcatgcactcaaggagcactgactgagcatcctgcaactctgtcctgtccccagaagccatgctttgtgagaagtggggtaagcatcacagaagctggccactggcaggcgcatgcagggcttcagacctgctcctgatgtaatctttgctgcacattcacctcacctgaggacctgtggaaactagcacccaggtcacaggccctgctaattaaatcagaatgtaggagccaggcaacaataaatagcgctgaaatatccccagctgattccagtgtacagccaagtttaggaaccgtgtcctggtgtttccctcctactcttgctaatatgtagctctacatatctgtgtggagtgagactggcagaaaggctgtctggatgctccttcctgtatagcttggaggcaaatggactctatacagctcaggg

SEQ ID NO: 12937 - DNA, 1972 bp, Homo sapiens
tgtaatcccagcactttgggaggctgagtttacattctccccttttagccaagatgtgccagagatgacattggtgaccaaacatttattttttcccatatctttgccggggtggtgtggctacctgctgcaggttcattctgttctttggtgggatccttatggccaagggacttggagccaattaaacattctaggccagatgaggatggaggtgaacaggcactcattaacccttaaaaaccttttgagcaacagaagagccaaaaagcaaggttacaacagtgacttacctgtaagttctatgtgacgagtcatcagctgtttagtaacctgtatgacctgttaaccatttttgtagcctgtgaatatcagatgttcatttaagtcagaaccttaaacatgtggatatttttgccaacaactcagaagctaacaaaacagctaacaacttagctgttttcattgaaccaacaatattaaattagtcttatttgtcaaaaaattcacacaaagatcattctctttttgactgggtttatagtctaataatcttttgtgccaaatcctgataccttaaaacacctagcggaggcaaatataaaataatcagtaaacccagactaaaaaaaaaatgtatgctgacaattctgaagacatttctagttttattttaccaataattttaaaaccattttatttaccagattactaagttcacatgaatctgaaaagtatttggacttacttagtttatgagtataatttacttataagccagtttggtaccatgctagatacaacacaacataatacatgttcatatacaaacatttaaacacatacacacaaagatcttacagcttttactctggaaccttagccatgagatggtaatacagactcaccacttaacaaaagacagctggatccaaattatttctgacaaaattgggacctgttcacatggctaaactttatttgtcccagtaggtaatccaatgaaggctatggaccaaagtcttgggaaaagtagttttcatggcagttttatttttaaaaaccttttaccccttttttttttcctgaagtttcaaatgagttttcagtgtttacattttagctacaattggctgaactgtaaagaaagctccaagtagccttgaattagtagtatcataaacaatgagttttatcttaacagcagtagcttaataacagcaaattcaaagcaggccgaaaacaaaaaagagatagctttagaaaactctacattttaattgtatagttgcaggttgggcatttgagctctgaattttccttgctgtaatttgcccgttcagttttaaaatgtgcacaagaacaggccacaatatgcagctagctgaagtgctggaaaacctggcatgcctttgaacttctacaggagttcctgcccctagtgggtaagttacctattgcactgactttatgaagatatctcttccagtgcccttagtgtgagcatccccacaaaccttatgaaccagttgaatccaacctgaatgcctctccataagcccggagcccacaaatgcattttctccagggcccttggatggagggaatcaggaaggcctcctccaaacccaaggctaggagagatgttccctccggggtccagggaggagaacagaaaggactgagaagaactaggaatgccctcccaaacccaaggccagcaggagggtctcctccggagttccacagatggaggaggcctaaaagaagaaatcaagtctgcaacctaaaagtgggagatcttggattttgatagcacttacccagatcctttcccagcatagtcaggaacaactggactttttcaaagggaccttggctgtacctggtgtcctgggtgacacaggaaaaggaattcaggggctgcttcagaatcccatctttgccagatacgttaactttaaaaaaaaaa

SEQ ID NO: 12938 - DNA, 836 bp, Homo sapiens
tcgagagccttgtgtccactgtggctctggagccacctgtggccaagtgctggctcagcgcctctgctcctgggcagacggggcctggcacccttcccagaggctctgctcctgcatgttctgtggtactgggttggtttggaaaaggggtccttggaggagtgtaggatgtggtgttgggcagacctatgtccccttggagggcctaggccacccagatttgcctcttggtccttctcatctggagctggcatcatggtggtagtagatgtgtgtgaattaattgcatgtaatgcctttccaggaatcctttcaaaccaagggacagaaatccactcaaactaagagaaacatggagacttctcagagggcctcagggccacttgccacccaaaagaccagcaagtctgcctgggtcgtgtgagggctctgggattgaggcgcgtctcctccctgctagggcctgtaggacagtcccaaaaaggctgatgtctgactcctagggagacgagaaagggggcggggccggaaacacattgcagcaataatggctgagaacttcccacaaagacacaaacctgcagacttaagaagctaagcaaaccccaaataaggctcacagacacgtgcagatgcatgcaaccaaatgctgagaactgggggcaaagaaaaagcccttggcagccatcctctgtcagcagtcagacggcggtggcctggtactgacaacagatgccgcagtgaatgaccgtggcacttttagaaacccaggaggccagaaggaagaaggaagccccacacatcttccagtgctgggagaaaagaaaggtcatccc

SEQ ID NO: 12939 - DNA, 390 bp, Homo sapiens
tcgccggggattgcagccctctcctcagtgatggagcctcatagacagtcagcgagagcacggagcccgatgaccccacccgtgggttggattgaaatgacacatgcactgcagcctcaacagcagaacacccatcttttcaacttcacaaagattagccaccaagatggagcatacctgtcacaaaagagcccttaacaaattttaaaaaatcaaaaccatacgaagtaagttttctgaccatggtggggttaaattagaaatcagtaacagagaacaggaaagtctccaaacacttgcagactaatacaattctgagtagtccatgggtccgagaggatgcctcaacaaaaaaactttaacaaactgtacacaggaaaatacagcatg

SEQ ID NO: 12940 - DNA, 38771 bp, Homo sapiens; identical to SEQ ID NO: 12795
  misc_feature (29356)..(30880): n equals a,t,g, or c

SEQ ID NO: 12941 - DNA, 164 bp, Homo sapiens
ttctcctgcctcagcctcctgagtagctgggattacaggcacctgccaccatgcctggctaatttttgtatttttagtagagacggggtttcaccatgttggccaggctggtctcgaactcctgacttcaggtgatccacccacctcggcctcccaaagtgctg

SEQ ID NO: 12942 - DNA, 139 bp, Homo sapiens
ccaccacgcccagctaatttttgtatttttagtagagatggggtttcaccatattggccaggctggtctcaaactcctaacctcaagtgatccacctgcctcggcctcccaacgtgctgggattacaggcgtgagccac

SEQ ID NO: 12943 - DNA, 924 bp, Homo sapiens
caggtgcgcaccaccatgcccggctaatttttgtatttttaatagagatggggtttcaccatgttggccaggctggtctcaaactcctgacttcaagtgattcacctgccttggcctcccaaagtgctgggattagaggtgtgagccaccgtgcccggcatacatggtcttctttcagattcagtccttgctgtccttcctggcttcatcactcagcatcatcttcctcctcccacgctgcctgattcccccagccaacggcactgcagggagcagctgcagtgaattccagaccttgcacactttccatccccaggcctcctgtgctcacgctggtccctctaacctgtacacttttctccgcctctttgatttgtctgccaaggtctcacctttgatgtgaagtcctttgccaagtcttctctaacttcccttgagttaggtgctggtatcccttagggaaatttttgactactcataacagagaagtgacaactgtggcttaacaagacagaaactgaatttttcatgttaaatgaatgtggaaacagagtccagcgtggtacgacagcttgacagtcatgacagtcctggctccttttttttttctttcaaatctgggcaccgacctccttcttcttctccttctccttccttcttccttcttcttcttttttaaaattttatttatttattttaaagaatacagaggctgggcgtggtggctcatgcttgtaatcccagcactttgggaggctgaggtgggtggatcacctgaggtcatctgtactaaaaatacaggcgcctgtaatcccagctacttgggaagctgaggcaggacaatcgcttgaacccaggaggcggaggttgcagtgagttgagatagtgccactgtactccagcttgggcaacaagagggaaact

SEQ ID NO: 12944 - DNA, 5775 bp, Homo sapiens; identical to SEQ ID NO: 12799

SEQ ID NO: 12945 - DNA, 738 bp, Homo sapiens; identical to SEQ ID NO: 12800

SEQ ID NO: 12946 - DNA, 84 bp, Homo sapiens
ggtggcgggtgcctgtaatcccagctacttgggaggctgaggcaggagaatcgcttgaacctgggaggtggaggttgcagtgag

SEQ ID NO: 12947 - DNA, 1055 bp, Homo sapiens
agaagattttccaggcaaaacccagatctgctttagtgacttcagaagaaaaagatctgagggaggatgagaagccgatagccaatggtatgtgtgtgaaaacacgtggcagacacacatgctctccagcattctatctcagctgatggtcagcaagccttggggcgtcttcatctccttctccttcatctcactgtctttctaccatgccatctctatcagttcagttcccagtggaagacaggtggtttagccaaagaaaatctaatgaggggtctatttatctgtggtcagggtttgggatgcccatgtgcagtagtgatgccccagggatgagcaagagtgggaagctgtggccaccttgagacctcagggccaacagaagggactatgcttctggagccctggggagcgggagcttggaagagggcaagaggggtcacctcagaagctatagtcacagggagatgcaaccactgcccagactgtggcaaggcatggcgggagcagggggaatcaacacccagcacctgtccctttgaccctttgacttgctggtggcttgcattggctaaaccagaaactggagggcaagagcccctcagtgtagcagcctatgggggccaaccttctgaggtcaaagcaggacagaaggtggagaagggacttggggggacacatggagaacaatcaacaaagtttaccccctttgtcacttggcactggaaaatctgagaagcaccagatgttgtgagttacctaagaggggtttgttgcttcaatgtctttccaatttgggggatttttgaagaaagtgtttatgagcagggcagcttgcccctttacctagtcttccaagaataaaagacaaggcctcagtttttagtcagttgtaaacacttatattctttatttttaggttatgaggatgagggtcgctatccaaaggattgagagagtaggcttttgcactatgtagccatggattcaaatcccagcattaccattgattagcttggggcttttataaagttagttacctctcttagtctcga

SEQ ID NO: 12948 - DNA, 1055 bp, Homo sapiens; identical to SEQ ID NO: 12947

SEQ ID NO: 12949 - DNA, 16423 bp, Homo sapiens
attcaaggttgccaaataattggcttccaagtttaaccataaaagataataaaagatgcacatttttaaaaaaaaggttggaaaaattactttatgaagccttaagcactaagaataattaattaaactgtaatccaggattagatacaatttaataatagttcaattccaaaataaaagttattgtaggtaagaccatgaaatttcctaacacttgattttaatacattgcgctaattttctaaaacaactcagaggaacccatatttacagtaggcagaatatttatgaaaaaaatctggcatcaggtatatttatatatatgtatgtgtgtgtatacgtatgtgtgtgtatatatatgtgtgtgtgtgtgtgtatcccgagattatatgaactaagaaacaagttgtgtatcttaacagcagtactagagcgcagagtttcagacttggatttataaatgctttcaacgtgtggtgtttggaaaaggagaagacatcatctgattttcaaaacctgaagtttttctcaggactgaagtcaaaatcgtaactgccacagagggaaaagggaagcttttccccttaattgttcatctgcgtcagaaagtccagtatccctgagataggaaccactgtaattagaagattggaatgaacaggtttctcccaaaggaagattgtttgttgctgaattatgcctactgccctgatcatcaggtataaactttgcatcttccaacctaatgcttggcagcaccaagacgtttcagtaatggttcatcataaacccagcattctccatcttcatgaaataactgtaagacaaagaggaagaatttagttacatatttgctttgtacttctgtaatatacttactatttcatatctgctccccaccccgccattagactgaaatgagtttcaagtagggaccagcgatcatcttgtttataaacagtgtttggcacatcacttcttcaacattcactgaaataaattaggaggaacagcacttaggagggtggggcaggcaagcttacccttgtctcccactgaatttccttctccttcctttctcgggcttctgctctttgtctttcttcaagcctgtgctttgcttcagttgctgcatcaatgtctctgatttttaagttgaaagtgacatccttccaaaggctaaaacaaagaggtaagaggagctgccaatgttgagaatgaaagcctgcagccatcctgaatatagtataatacaagtcaaatggctttaagtgctgtaggtcacagactaaatctccttacgctggcaccagggcactggagtaaggaacagacatatgggctcagaagactccactgctagttgtcaaagaaggaaataagggctgcctgatagtatgataaggtcaacagaagaaaaagaatagtggaagctgagacctgggattctacttctggctctatgtctaacttactgtgcaactctgggtcaatcagtttacctctgtagggcttgagtgtcccttaatatatacctgtaagtgttagaggaactgagaagttccatttcagaaaaactcccttggatttaacaatatgatggagaaaatagtatgaatggagagaataagggtcaagaagtaaattacagaggctttaaagttagttaagatgtggcttcctctcaaggcctttattctcatttcaggaaagaaggtaaagagaagttagctgactgagccatccatggtcacaaaggtagtaagtggtagttctgacatacgaacccaggaattcaaacttggtctatactattatgctctgccctactgtctctcaaacccagccctgtgcctacgcctaggcaaagtttaagcactgcagcaatagttccacttaacaatgtcggcttacctgcgggattcatactcgttctgatcttccaacttcctcactttcttcttgattataggcaacttcttggtatctacaaagactgtattttcctagaaaacaatagaggtggatgggaactagacccataaacccctaacctaatgttagatgcattgtagtgcttttgacacttcaaattctctaggtccaaaatgcagttaactggctcctcctgttaatttcataacatctttcctctgtttaagaacactgagtgggcagtagtacagagtgcaagttctttgaaggaaaggtctatcttaactcattttggtatctctggtgccaggcagtcagtaaattttattatacaaaatcttcaactgtgtgtgtatggaaacacacagtttagtgcttcattttataaacatacgccacatacctaacatttactgggttcttactatgtgccaggcattgttttacatatattattctcaagtgttttgagagcagagagaaaagtaaaaatgattataattacctatactgctgggagaaggtgggggaaggaaagaaaaagcttgccctgaagagatgacatacactggagctgtcctaaagttccagctctaatatactgtagaaggaaatgcattatgaaggaagtactaatgaaggaagccagaaaaagggatagagtacaatctaatgtagcctaaaacaagtggcaaaatagaggatcttacccctgttgcatattttgcatacatcacaccattccattccccttcaattgagcaaaaagacttcttgtcatttggagaactgaacagaaaaggaaatacttgtgttagtctcaagttgaaaattctaccaaagaatctgctcagtgtggcccaactacagagtagagcacagaagagcaactgtgaagtttttgatgaaagcatcttaacagaactggactccccagggctaactataagaatgagggccttcaacaggacgcttatgaacttgagatcccaagaatggtgggtttgggcaagaacgtcctattctgggtgcaaggaccataacagagttggcaaattccctatcctcaagctgttcacagcgtagtggagagagacgtaaccaccattgaaattctaggtggtaagtgctgtggtgagcttacatgggcactgggggtcagggaaggctttgcttaagaatataatgcaggctttcatcctcaggttgaaagggacctctgtgccagatggtgtgaatactttccctgagcaaggatccattctgcaaaagccgtaacagacctctacttggacacacaactatggaatgtgagaagataagcaacacagcaaaggcctggttaggaagggcaaggcataaacaggattgaaagaggccagaaaagggagacatgaccagggcagagggaggagagctgctatcaacgcctgaaactttctttcccactgtccccttcccccccagttaagggttccagaggcagagagagtcatggtgccatcactatagactttccactgactggcacagtcatctgcacgtgacccaagagtgtcaagtggaagcaagccagatgcgtgcaaaatgtgatggttactgtttttccccagcaaaggcacagaaaaagggatagctgtgaggaccaggaggcagtgctgcaggggtcacaaagtctgctgtaaggaccagctcatcattcaatctggcaagaataaattagggatccataatctggtttagctaggcaacctaggaaggcctcttttagttcaacattgcaagtcaggtttttaggaaggaaacctatcaatgacctctgactgctctgaatatatgttttaggtcttcttctgatatgggacttcagcaaaagacatgacacataaaatgtgaaacacgcttacaaagacagaaccattctttcacactcctaatccagaagctgtagttcaagacaaaaggcagttatttcagaaaagcataagagctctaaggcagaaaaaatacctacaaaatctcggcagtaattctgtgcttcttgcccccatagaagggtttagtgtggaagatgatatttgcactatagcctgttttggaacaattaatattgcattctcctcctaattccacccagggcactgtgaggatagacctgcaaaatcaaaagtttttaggtaaggttgacagttaagaggaagagggggaaggggcatgtctcaaggaacagcagagtctactgctgatcagaggaaatggacacacttgccttccatagccattggggaatgtgagaatgtaatgttcatcatagtctagacatgagacacagcctgtggagagaagggacagaatctctgatgagtagtgccaagtggccacaaggctttcttgtcgagctgatggttactccaggatactccattcaatttagggataacctatctagttccccaccctttgctctcacccccaataccaatgcttagttgctaacaatgacatctagtctagccattttcataaaattctcctataacattgtagtccacccaatgccaacacacttaccctgccctatgttgtgcaccccaattgacatcccaaggaattttgatttggtccagatatgagcattgaattgtatcttcttgttaaaacactcagcataaaaggctgaaactgaatagaaattttcaattagtagattatatatacctacagccacctctccaaaatcacataacctggggaaataattggcttcatggggaaatcctttacccttcaaacagcctccaattacgccaggaggtacctacctgccttttatacccttttccccaatgcaagcattcattcagagccacgtgggcaggatcatccctgaaatgatgctgtggccaacccaggaagcttaaaaccaaaagggctatctgttctggtctgcaagtacacccaggctccagccccaacctaggcccagccagtgtttccagttttaatactgcactaaacaaaccagatgttgagggtatgtacagttgaccctccatatccatgggttttgtacccacagattcagccaactgtggatctaaaatatacagaggctgggctcagtggctaacgcctgcaatcccagtactttgggaggccaagacgggaggatcacttggggccaggaatttgagaccagcctgggcaacatagtgatacactgactctaaaaaaaaaaaaaaaaaaataagaaaattagttgggtgtggtggcacatgtccatagtcccagctaactgggaggctgaggtgggaggatcatgtgagcccaggaggctgcagtgagctatgattgtgccactgcattccaccctgggggacagagcaagaccctgtctcaaaagaaaaaatttaaaaatacaaaataaaaataatacaaataaatagtgaaacaactatttacatagcatttacattgtattaggtattataagtaatctagagatgactcaagtatacaggagggtgtgcataggttatatgaatataaaagacaccattttatgtaagagacttcagcatcctcggttttggtatctgcagtatgccaggaatatactgtgtagaaactacgtatcacttatataaactgtctcacagttgctgaggtctctacagcacaaattactatatataagatgactctggaagcattaaaagttggtttcctaaatcccttctttttatacgcacttaatttgtgaagctaagagtctggagcttacaaaaggaaaagatatgaggaacaaatcaacttgagtttccacttcagggaataagaaacacacagctagtcacacaactgacagtaccctcagctatggcgcttttaatgaccctctttagacagaatagttttgagagcacaggttgcagaggagctctgtaacttactgggtggatgatgggaaacctgctcagccacaaatgttacactgtttttggaaacccagggaactggtccttctgaaactagttcctgcaagcaaatataacataattttcttttgatgagaaaacacaaatgacatttcagagaatctggtaattggggtctctgctcgctctacacacaccaagcaccctatatatatatttctattgtagaacttaactacaatattttaattgctttgtgtcagtctccctgactagactaagacattcttaaaggcaaggattgtgtgcctcattcagggctgacaagagtaggcacttatcaatgtctgccaaatgaataagaacagacacatacttgtctgtcttcagtatggactatacgtagtgcatcacttggagagggaaatatatggagaatcatgtttactgacagattattatgtgtcaggtgctgtgggctatggttttgttttttttacttcttaaagcctttttacatgcatttgagtcttccctgctggtcattttcttcaaccactaaatttgttggagcctcagagccagttctgggttacctactcttctgtagctatgctgtcttcctaaataattttatccaatcctagagctttaaaatgtcatctaaatacactatactctttgaaagccccatccccatctcagacctctccctaaactccacactcttaaattccatctccctacttgacagcttcacagacctctaaaactttatattttatattagcttttgatttttccctccccaaatccaatcttttccttatcagtaaatgacactgccactgcttacatccacatgcaaggattcatctctgatgtctcctttcccttacctcccccaatccatcaatcagttctacctccaaaataaagcttgaatcaccatgtctctcttggaataatgtcaaaacctccacaatggtcttcatgcttctatatttgccccttctcaatttatttttcacaaaatcattctattgatcttctcaaaacaaaaatgagatcctgaaaagccataaaattatattatggtctacaagaccttgcaagatctgatttctacatccccatcctcatctcatcctactctttttcctccttctcactacattcaaactatgctgctctaacaacaatttcttctatgggtggtgaccatcttttgatcattgctttcatcattattatttgcccctaaataaaatcttgaatcagtatacaattaagataatttaaaaatgtcaatgcagaactcactgtgttctcttcagtatcatttggtaatgtccaatgacactgaaaaatctcgcccaaaatgggattgtatggctttttggcaactgatcctttccttcccgcatgaaaggctgagaggtaccatttcacaacctgaaccattcgatccttgggatccttctggtcactaatgctgcaagggagaaagacaaaatttaatgtcctgctttctggtacaagacaagatgatgcaacaacccccagcatggtccacctaagtcaggctgagaggactgaggacctaggaccaggagttagcttacagtttcattttaaaattgagtataatatatataattaaatgcattggtcttagtggttttttcttttttttttaatttcaacaggtttttggggaacaggtggtgtgtttggttacatggataacttcttcagtggtgatttctgagattttggtgcacccatcacccaagcagtgtacactatatccaatgtgtagtcttttatccttcacacccctcccacccttccccttgaagccccaaagtccactgtatcattctttctttttgagacggagtctcgctctgtcacccaggctggagtgcagtggcgtgatctcggctcactgtaacctcacctcccaggttcaagcaattctctgcctcagcctcccgagtagctgggattacaggtgcttgccaccagcttggtttttcattcctgagtctcttcatttagcataatggtttccaactccatctagattgctgtgaatgccattatttcgttcctttttatggctgagtagcattccacagtatatatatgccacgttttctttatttgcttgttgattgatgggcatttgggctagttccatttttgcaattgcaaattgtgctgctataaacatgtgtgtgcatgtgtctttttcatataatgacttcttttcctctgagtaaatacccaggagtgggactgctgaatcaaatggtggatctactttcagttctttacggcatctctattctgttttccatagtggttgtactagtttacattcccaccagcagtgtaaaagtgttccctttccaccatatccacatcaacatctattttttttttttttaatatggccattcttgcaggagtaaggtggtattattgcattgtggttttgatttgcatttccctgataattagtgatgttgagcattttttcatgtttgttggccttttttttttttttctttttgagatggagtctcgctctgttgtccaggctggagtgcagtggcgcgatcttggctcactgcaagctccacctgccgggttcacgccattctcctgcctcagcctccccagtagctgggactacaggcacctgccaccacgcccagctaatttttttgtatttttagtagagacggggtttcactgtgttagccaggatggtctcactctcctgacctcgtgatccacctgccttggcctcccaaaatgctgggattacaggtgtgagccaccgcgcccggccaaccatttattttattatcattatcttcttttgataattgtctattcatgtccttagcccactttttgatgggattatttgtttttgtttttgtttttttttcttcctgatctgtttgagttccttgtagattctggatattagtcctttgccagatgcatagtttgcgaatattttctcctactctctgggttgtctgtttactctgttatttcttttgctgtgcagaaactttttaatttgactaagttccatctatttatctttgttgcattcacttttggattattggtcataaagtctttgcctaggccaatgtccagaagtttttccaatgttatcttctagaatttttatgattttaggtcttagatttaagtctctgatatatgttgagttgatttttgtataaggtgagtgatgtggatccaatttcattcttctacatgtggcttgctagttatcccagcaccatttgttgagaagggtgtccttttcccactttatgtttttgtttgctttgtcaaagatcagttggctgtatttggctttatttctgggttctctattctgttccattggtctatgtgcctgggtcttagtgttttgcttgaggatttgacaaacgtatatatctatttaattaatcgtcacttaatcaaaaaacagaatatttccattaatccagaaagtttccatatctccctttccaaacaatcgccacatcttacttactctgaggcaaacactgcttctggtttctagtatcatagattaagtccatgtaagtgcattgcttaattgccaaataattggagattttctgtatgttatcaattactaatttaattcatgggtgtagaatatacaccctgtatgattccaattattttaaatttattaagacttccctatatatgttctatcttgataaacatttcacatgcacctggaaaagactctgtgttatacaattgttgggtagtgtttagaaaggccaactgggtcaagttgatttgatatgctgtttaaatcttctatagccttcctgattttttgggggggcggggaggtggtgaaggcagaggctacttgcttcatgagaccctgacggatgaatttgtggacttggctatttctctttttagtcaatttttgttgctgcatgtattttgaagctgtgttattaggtacatacatatttaggagtattatttattcttgataaatagatgcttttatcattacaaaatattcctatttgtctctaataatatttcttgtcttaaaagtctcctttgatacttatacagatacaccagtttttgctatgtttagtgttttgcatagtatctcattttccatccttttacttttaaccagtgtctttaaagtttctctcttgaaaatatcatatagataaatcctgcttttttaatccagtctgacattaaatggagtggtaactgttgatatagttgggattaactctaccattttaataggttttctacatgccccctttgttccttgttcatgccattatttctccttttctcctttcttagaattaatggagtatttgtatgattccgtttaatcttatctactggcttttgaactgtacttttattttttttaagacagggtcttgctctgtcacccaagctgcagtggtgtgattatagctcacagtcccagcctcaaattgctgggactgcatgaccctcctgccttagcctcccaagtagctggaactacaggtgcacaccaccaagcctggcttattattaaaaatttttttttgtagggacagggttgtgctgtgttgccctggctggtctcaaactcctggcttcaagcaatccttctactttggcctcccaaagtgctgggattacaggcatgagccactgcaactggcctgtaaatagttctgggggcctcaaagtttaaattctcacacataaaaactacccttaaatctcaaatctatacccaatgaacaactggtacgttccatttttgcttacacgttactaataaatgcttaaattttacttcttaaattatctgttaatttaaacactgccatatttatttaaatttctgcctttggggaattggttattcttttaaatcttcatcaagaaaaaaaaaatatatatttatcaatgtcagccaatgtatccacccagcaagaaacttcagtgatatgtatctagcttcagtaaaccacagtctgagactaaggaatgcagagaagacgaactaacaacattccccattacaaaaaaatttcctgctaccagcgaaaggcaatgtgaactcacctccttgtaaatcaatttcacctttacattacttctatctcatacatatacacatatataatattgcaagctttatatttaaaatttataaatcatctataatttggatactatattgtaagctcaagggcagacatgacttttcctttctccaacttgtaagaaagtgcctagcaaacaacaggtgctttggaaaggtttgctgaactcagaaaattaagcttcattaggatatagtacaaataatttgacagtgattgccagtgcctggattaaataaacttataccattggccttgtgaatattggctacctattaacgggctcttgagaattttttaaagtgttaaacttggttgcctaacatcgccaccatataactttaagcaaacaggcaaccagtgtaaacacattattcaataccacagaatacccagaaatgtttgaaaggtgacaaggaatccatctatcctgcaaaataaaaggcagaaagctgctgagtaacatctgtaaacgttggaaactaccatgttcagtcaaatacctcacaaacaggtccggatgtgcaaaaaagtctgcatacatttctaaaagagatcttctttcaagaataaacgttggaagaactacctgaaaaacatacacatttgacccttgaagatcaaatttctcttcagataaacagactaaaaaaaaaaaaaagaaaacaaaacaaaacaccacctcattcaaatcatggtaacatccaccacatattgcccaggcatgctccaaaaactaattctcaacctgtcagattcagaaatgaccattaacctgcctagcagatcaaaaacagagaaagacttttgaatgttcaaatgtcacttcctctgtgaaacttcctttttctccctaagtatagtaacaacaacaaactactcaacaaactcactcagaggaatcctttgatgcctcctatctgctggacattacatatacattattttattatttgtatattacatacatattatattacaatagccctatgatgaagaaattattacagtgaagaaatatgaagctcagcgtcccactattaattgtcccattattaatgtggaattcaaactggatctgagtttggggcgtgtgtgcactttctactgctgttgctctatcatcattagacaagtgtataggaaatacatgatgagcacctacaatccaagaattaagttttattcacactcgcgctctcactactatttacacagtaagaaacttttaaatgagcaattaaaggaataaacaaaaagaagaaaagaatacagactgggaaccaacaaactggaatacgggaagacatgagaaagatgattaaccaatgaaaaaaagagaagaatttcattagagaatgggaatgggagaagagtttttgaaatgagtatcagattatcaattattcattacgaagtagaacaccccagagtaagcaaaaatttcttaacatttagtaataactacatatccactatattcaaggtcctgtgttaaaagctgtggtggaggctgggcatactggcttgtgcctataatcccagcactttgggaggctgaggtgggtggatcacccgaggtcaggagttcgagaccagcctggccaacacagtgaaaccccgtctctactaaaaatacaaaaattacctgagtgtggtggcgcacacccgtagtcccagctactcgagaggctgaggcaggagaatcacttgaacccaggaggcagaggttgccgtgagccaagattgcaccactatactccagcctgggtgacagagcaagaccccatctctaaataaataaataaataaataaatgcaagcaagctatggtggagacaaaggtaagtatgagagaataacaagagcatttaaattgtaggtggaatgtgacaaacatcatacaagaatgctctaagcaccctggaagttcagttcaaggaaagatcatgctctgtttgggggaacagaatgagggcagagctgggaaacaatttattgaggtggcactagagaaaagccttaaagaagagtaaggctgtgataaaagaacaagacatggagacgggagaaaaaaaaaaagacaaggaaaggataggaagaggggtgtgacagggattaatcagtgaaccagtgtggctggacatataatgaaaatataaagtgggctgatgaacacaagcttggaaagggacactaagactgtaacacttagaatctctattatcagactctcagcatttaaattttaggtaaacatttttcttccacagaacatgtaaattcataatccaaatagggttagattagcagggaagcttatatactgccttggtacaacttcttaccactttagataacgcagaattataaaccaccgagtaaaaatgctgaagaagaaaacatggataaatacctttaatgtataaacagctcttacaactcaagatgaagatcactactccagtagataaatggacaaaggaactgaacagccaaaaaacatttttaaaaagtttaatttcacacgtaatttaaaaaaaataaatatttttttcttctacttaggatttttctgagaactcttatttaacagattttcttcaatgtttgtagtgctatactgatacatgctattaagtcaaactgctgtaacagtgatgaagagagctgggtttagctgtcttcaacctgggttcaagagcttgtttagcctcttcttagctgtgaggaggccctgaaaaattaactcaatttctctaagtacctgaaaaggaagataattacatgccctgcttatatgttagggttcttttattttaaagactgagtgaggttaaatgggatgtgactgtgtagtatttttaaaaactacaaagtatttggaaaacaaactctttttggaaagtatctgaagtgagaaaacattcttataaaagacacaaatttaaggcattattgtaacaatactttggaatgcataaaaggaaccaagatttcagaatctgttggcaatcacagccatttgtgccaataaaaatttcaaaaatgacttattttaaacacattcagtaaaaaataattatgataatatcatttataatataacaagcttttagcagctatggactcaaatatggtttatttggcagagaaaattatgtgaggcaagaattacaaacttgattgtggcaaatacatctggttgcctctccccatccatgcttcacccccaagaactctgattcagttcaggttcagctgtgggctgccatggccttctcttccacgtctcaaggggtgaatgtggattcatttaaaccaatcatttagcctcccccttgccagtggcaggtttaggcacgagcatatgcctgatactggccaatgagattcaacaggaagcctaatgagccactcctggaaaacaacgtccttcctaacaacaacaacaacaacaacaacaacaacaacaacaacgccagcagctgtacaatctaatgattactgaagcaattccggggacaaactcctgcaaatgttctcctacctagaacattcctagtaagtgtgttgggctccacaaataaaagttgtccttgtgtctctgttctcacttagattaggggtaaaaggttttattacagacacttacttgaaggtattatgaattagtctttttcttaatggccctctaaatccaaaacaaaaaggagttcactactgacaaagactataacactggaattgattttgccctaacaaaagtgagaactctaaatttaatcaactccccaaagctcggcagaacaataatcaatatgaaagttaatacagttcaagccttcaagacaaaggcagtagtggaaagattacaggttttaaaatcatggagcagattagaatctcagtctgccacttaatatgacttaacacgactcagccacattacttaacttctgagttttagtttcctgatgaaatgaagttaataacacctactctgtggtactgtggtgagaattaagtgaaaggagggggttttctagcacagtggcaggaatatacaaaggcacccatacaccagtctcctaattcaagcatgcattctgttgagagctccaagtttaaattcaaattcaaatccagactatggtaattttgcatgactcaatatgtgtcattttgcgtgcctgtagtcccagctaccaaggaggctgaggcaggagaatcgcttgaacctgggagacagaggtcacaaatatgtcacaattttacatttactacctcttccaatccttacaataaccctctgaaacaggttactatgtgtccaatttgcatagagaaccctgaagtccacagaggaagaaacagaagaaactcactgaagaccgtgcgtggtttgctaatattagaggtaggacgaaaacacagatcctctgaccctaagattagaactctaccaaatcttaatccatacaactcatacacactgttctctatgaaattatcctagcttgacttatttcatcatttataaaattttgtttacttatctacatctatattaaatcacaagaagacacaggtataaaaagaaattatgtcattttactacatttgcaggcacactcaccacgcaatcactgagaatccatacatacccacacagacttacagcaaatttggtcttaccttagtaagatccattccaagtctaacctgcgacaagagatgcatgataacgctcttgtgctcctccacagaccctgcctccgcatcatcatctctgtcatcatgtgaatcaaacaggtctaaaataaagcagatcttattagaatggtgctaaattgggccaatctgtcctgatactagaattacaattttgtttgtttgtttgtttgagatggagtctcattctttcgcccaggctggagtgcaatggcacgatcttggctcactgtaaacctccatcttccaggttcaagcaattctcctgaatcagcctccttggcagctgggattacaggcacgcaccaccatgcccagctaattttttgtatttttttagtagagatggggtttcaccatgttggtcaggctggtcttgaactccggacctcaagtgatctgcccacctcggtctcccaaagtgctgggattacggcatgagccaccacatctggccacaaatatttttaaagaaaaaaaagttaaattatcaaaggtcacttaccagcatcacttgttccattggacaaggaagaattaagtgattctgtggtatctgggcgttttagactatttccc

SEQ ID NO: 12950 - DNA, 709 bp, Homo sapiens
caatagccctatgatgaagaaattattacagtgaagaaatatgaagctcagcgtcccactattaattgtcccattattaatgtggaattcaaactggatctgagtttggggcgtgtgtgcactttctactgctgttgctctatcatcattagacaagtgtataggaaatacatgatgagcacctacaatccaagaattaagttttattcacactcgcgctctcactactatttacacagtaagaaacttttaaatgagcaattaaaggaataaacaaaaagaagaaaagaatacagactgggaaccaacaaactggaatacgggaagacatgagaaagatgattaaccaatgaaaaaaagagaagaatttcattagagaatgggaatgggagaagagtttttgaaatgagtatcagattatcaattattcattacgaagtagaacaccccagagtaagcaaaaatttcttaacatttagtaataactacatatccactatattcaaggtcctatgttaaaagctgtggtggaggctgggcatactggcttgtgcctataatcccagcactttgggaggctgaggtgggtggatcacccgaggtcaggagttcgagaccagcctggccaacacagtgaaaccccgtctctactaaaaatacaaaaattacctgagtgtggtggcgcacacccgtagtcccagctactcga

SEQ ID NO: 12951 - DNA, 29449 bp, Homo sapiens
tccaatcagaaaaattcatgctctgaccatcacatgggcacttcctcctcaacagcaacattacaggtaagagtttaagggaaaatttacttcattagaaccaagtgagagtaatttttaaagcatgctaaatggtttaagtttgggggttctgaatttataaacatagcaatacggtaacctggaacttgattactccgggagctttcaagccttgctatgtattttactattttttggatataaaaactagagctttctcagttatagtggcctttcttaagtctttgaaattaagtgtttagtgtgaatgctaacttttgtaatttgtttcgatcttgtcaaaaataaagttaaataatttgggcctggcagactggccaacatagcgaaaccctgtctcgactaaaaatatcaaaaaactagccaaggcgtggtggcacacacctgtaatcccagctactcaggtggctgaggcacgagaattgtttgaagctgagaggtggaggttgcagtgagttgatattgcgccactgcactccagcctgggttgacaaagcaagactctgtctcaaaataataataatttggattggtaatatgactagggtacataaatcccaaggatttactcctctgaattagggcaggtttatgcagattgggaaaggagttctacttgtctgtatagttatcttatatgagcagtgtagcatgggccagagaattatttaagttaaggatcagtcaatgcctacaaatgcttttccagttagaaataaatgctaatcaactgataaaaatttaacttttttgggagggggggtggggctcaagcagtccactcaccttggcctcccaaagtgctgggattacagacatgagccactgtgcccagccaaattcatattttaaacaaggttgtatgggctttaaggattgcctaacatagttgaaaatcatatcttgacattcaagaatttactgaatttaactgtgtaacctaattaaattttctcatatatacagaaatatacagaaaactcaatttttttctgtatgtctttgtggtaggaatactttaacaaaattacagtagaggccagggggaaagacagtttgaacagcatgtgcacaattactcggactattacattattagtatgtgataaagcatttttatacttgttattgcattttcatgaaaactctgtgagtaagtagttgggcaagtgaagagaaaaagaagaatacggttaagtatcttgctcaaggtcatgatttacttaaaggaaaaactaaaactagaaccaagattttctgaccctctgaacaacacatttcattttaccacagaacccaatgtggtaccaaaagcttttacagacagtaattcatacctatattaggttctagactgataaggaatctacatttcatattgggtgaagcaaaaagatttatcatgagagcagataagtttggtgtccaagagaaaaagtagtgcccttaaattttgggatgattgtactcttcagtaatctcaaatgaaagagttaattttactatattttctgtttttatcttcctgctactaaattaattataatttcatgtttagtggacatatgtgagaataagtttgtgattatattttcaattattgtagccttagaggtaagattttctggtgtatttataccttttgtttttttcttctgaccattaaatttttttaaaagggtgaagccacttcattatatatcctggctggttggacatgaaggcaaaggcagcattctttctttccttaggaaaaagcaagtattcaattaataagtattttcagtatagcaatctctgaaaaatagtagacaataagtattatataatgcattcttttactttagctgccaggaagcctagaataaaatttaatgcttaattatagttattttaataacttacattattttaatggccatattatatttgtgtatttccttgtaagccaccttttagcccattgttggaagttatttgtacacaaaattttaaaaaatcataaatgaaattaatagattccagaattacataaaagaattagctctaatcaagaatttatatttgactgaatggtaaagaaatcaattatttaaatgccatggatctccaggctttcctaacccccaaggctagactttaatgaaaacttcattgggtaggtaaatcatagttaataggtgggactgcaaatggtatatgcagccatgttagcagaatgtttcctaagcattaaagcacctgtttaagtcacctatagccaaataatagaaatacaattttagaatcaagactaatatattaaagtaattccttgtttgatttttctataaatgaatagtatgagaatggaaggatagatgagacatttaaataagtatttttaagacactttcgtgtactagaacattcaaagaaaactaagaggggagagttaactataaaataataaactaatgatattgggttcatatgtaccttacacaatatatgttatatgctttgagctgtgcacaacctttctaccttactgagctttattagaatttcagactctattctggtgtcctctctttttaatttttcagaattaatctagtcagggaaaggtatagtctcattatttctttcttagacaacctatgtaggttagctgacagcctcaaagaactcacttgacattcaatgtaagtatgttttagaagtgtcttaaggcttctcctaggagacaggttcaaaaatggtgaggccaggcgcggtggctcacgcctgtaattccagcacttgggaggccgaggtggaggattgcttgagcccaggagttcgagaccagactgggcaacattgtaagaccctgtctttattaaaaaaaaaaaaaaaaaaaaagaaaaaaaggtaagcaaaatgctttccagcagccatcatttgaatattttgtgctgttctcttcaaaaggaatggttttggcttaataaaactgttaatgttttattatggtgccatatctattcgtatttgcattaaacaaagactgttatttccttctggtgattcctaaatgtaccacaattccttgggaggctttgtgcttttaaaatttgcacttttagatttactgttggaaagtatatgtttacattcaaaggctgagatttccacattttacatagaaagcctctatattttgttaatttgaatgtctgtagactgtcaatccaggaacattgattgggttaattttttccccacctgtagatgctgggctcttgcactgtttggtggaaatggtgagacaggatttgagcaaaattctacttattcagtgttcagcatttctattacattgactgatgagggttatgaacatttttatgaggtaaataattcaaattcagttgttttttccttttacgtagatatcactttatgcaaaagactaattggatgttttgttttcaggttgcttacactgtctttcagtatttaaaaatgctgcagaagctaggcccagaaaaaaggtaataaacacttcctggaatgaggccaggagccagtcctggtatatttgaggcttcaggctgccggtagacatgctttagtcttgccttgatggtttttcaggcattttctgctctatttcctttattgactccatatccttatccctctacatgtgattgtatactaaggctttacacatatgtgggcagtccctttattttcacgcttctcttttattgttgatgcttctattgagaattttttaaacttttattctaggttcaggggtatatgtgcaggtttgttatgtaggtaaacttgtgtcacggtggtttgttgtacagattattttgtcacccaggtactaagcctactacccaatagttaccttttctgatcctctccctcctcccgcccttctccctcaagtaggcagaaattttaatgtatcttctaattatagttttctccttcacagaatttttgaagagattcggaaaattgaggataatgaatttcattaccaagaacaggtactggaagtcaaattctttttgcatgttatctgtgactgagttgaagctggtgtagacattgttcctctttttgaaagtgtcggtggagttttaattctgtcattctgtgtcatgtgagtctccaggtggccttgaagctatctgaaaattaactattgggtttttgagtatttatattgagtaagataaggcagtgagaggattaagcagatgacacagatgatgttgtgtggtaatcatttatctacatagtcatccatctatcccttcaataaacattcatggagacttgttatggtatttaatattttgggaattcaaatattgtgaagacattctataaggtaatttatatttaccatgtataatgttagaaacattgtgctttggaattcaggggaaggagagcattttccttgattgaaataggctcacaggctgggcactgtggctcatgcctgtaatccaagcattttgggaggtcgagcaggcaggttgcttgagcccaggcatctagtaaaggactgggcagtgtggtgttttgggaagcgtatgggatatgttatgaggtcagagttctgatgtccgctctgcctgtcgtttactcactgtgtgaccttaggcaagccatctagccatctagtcaggaaaaatccgactatgtttcctcattgtaaaacatgggactggaaccacttggtatctgaaggacctgtcagttttaagagtctgtgtatctgggtgctcggtaaatacttgaattgactacgttcctctggaaaaatatttccatttcatgtatcagtgaacaagtggtcattctttcagttttaaattaaaataatatttttattaatataacttcttatcgcaagacttttatctgacagtcacattttaatttttttaaaattttaattagagacagggtcttgctgtgttgcccaggcttacctcaaactgggctcaagttatcctccctcattggcctcccaaagtggtaggatcacaggcatgagccaccatgcccagtcaacacattttgattttttttttttttttttttttttgagacagagtcttgctctgtcatctgggcaggagtgcggtggcatgatcttggctcactgcaacctccgcctcccaggttcaagctattctcctgcctcagcctcccaaatagctggaactacaggcatgagccactgtgcccggcccaacacattttgatttctacattgatttgattcatgcttacaaatagtgtttagacgatagtgctgtagtgataggttgcctgtctttattgctcacataatcatgtggggcacttgactggtaaacaggcattcatagtccagtgtggtaattgctctcatgaagaggctgtgatatgactagaacctaatgggttatagggctcagagtgatgcatgaagggtatgagtttaagctccctaagggagtagctatggctatattttcttagaattttttttttttggagatagggtcttgctttgttgcccatgctggagtatggtggcacgatctcagctcactgcagcttcaacctcctgggctcaagcatccctcccacctcagctccccaaggagctgacactacaggcgtgtactgccacacctggcttatttttgcattttttgtaaagacagggtttcgccatgttgcccaggctggtctcaagtaatctaaccacctctgtctcccaaatgctgggattacaggcgtgagccactatgtccagcctactgagcatcagattcttaagctgcaattatatctcgttgtatctgttcagaagcttttggttttattgttaataagaaagggagaaagtatttgtatgttgtggtaaatcaaatataataatggagaagttctggtgtgaaataatttacctctttacagacagatccagttgagtatgtggaaaacatgtgtgagaacatgcagctgtacccattgcaggacattctcactggagatcagcttctttttgaatacaagccagaagtaaggaggtttatacgtctaaaacttacttttaggggaagaggagggtgagaaagtacgaagatgtatttaagaaccatgggaacgaagaaaacttagttatatttagtcaggatttttgtttgtttaaacagaagtatcaacagttttgtgaataatttctcatggttcttttacataattaagttttaatataaggagaaaatcaaactcagtacttgttaggtcctattttaataattttcaaatgttgaaacatctactgcaatagatgaagtgattcctaagaattatgtggtttccctgtgaaaaatacgtagttgtttagcttaccttttaattcagttggagagtcaggacaattaaatttttaatcattttgaaaatatttattaaaaaaatgtaaggttcccgaattagaaacatatgacttagggataatgttacatgccaatacattgtcggtcagggtcattccttcactagtggagaataagtcattttgtttcatacaggctagcgcgcgtcaaccagaggtgacttttgccttccaggggatatttatcactgtccggagacattttggttgtcacaactcagggtggggcgtggggtgctcctgggatccagtgggtggaagccagggatgctgctcaatgtcctataatgcagaaggcaggatcctaccatagttatttgacacaagatgttcatagtgctgagattaagaaattatagggcattccttgagatattttagcatagacgttcctaaactattaattttaaagaggacagggaaaggtaaaggaggaaggaacaaccacacattcttgccatgtcactaggatggttgtgcctggtagtggctggttgtgtttttttctgaaccaccatttgttgttttatacttaaataaatggtgtttaagtagtagttagggctccaaaccaagccacaaaattctgtttagtccttattgtagctggaggattactgaaggaggccctatcttggcagtgttttactgattcctggatatgaagtgatacaaaacatagctgttaggagcatagtccttggtagcatgtacaaatttagttagaactccacttttgccacttctagctgtattattctgtacaagttacataatctttaacctgagcaaattacttaaccatcacccaaagctgactgttattttgtgtaaataagtatatcttaggattgtttttaggaataaatgaaataatgtatgttaaatacttcctggctcacagtagaagcttagtagtaaaggatagctatttttactgctaatgctgttaatatgtaggatttaagataaacactgtttaaagcattatcaagaatatacttgatatttgtcaactatacctcaataaagtaggaaaaaagtttttgaaacactgttgagactttgtaaattagggtgttcatgaactgtaggtatttttatgagcatagatcttggaggtgcctaacaatgtgatttttgcctttttaacagagatgtattaggttaaaattgtgtgtatctctttcccctcttcccactttactaggtcattggtgaagccttgaatcagctagttcctcaaaaagcaaatcttgttttactgtctggtgctaatgagggaaaatgtgacctcaaggagaaatggtttggaactcaatatagtatagaaggtaaaatattttaacaattgtcttacatttaggtatatttaacttacctggaaatgtttattctttaataatttaatggttctagagggggaaaaagtataattttttaaaaagttcactttgaaatgaaaattacttatactactgcacaggaagttattttctgctatgtttatatttactaactagtgaaaaaattctgttatcttggtattttgggggcagagttttgacttagttttagaagaatgcttctcaaatgtagtgtgcatttttgtcacttggagatcttactaaaatgcagattctgagtcagagggtctgggtagggcctgagattctgcatttctcttttttcttttcttttttttttttgagacagagttttgctcttgttgctcaggctggagtgcagtggtgcgatcttggctcactgcaacttcttttgccccctgggttcaagcaattctcctgtccctgcttcccaagtagctgggattacaggcatatgccaccatgcccggctaattttgtatttttagtagaaatctgtctggggtttcaccatgttggtcagtctggtcttgaactcctgatcttaggtgatccacccacctcagcctcccaacgtgttgagcttacaggtgtgagccaccgtgcctggccagattctgcatttctgacaatctcccaggtgatgccagtgctgctaggaccacactttgagtagcacgattctagaatgcctggatatgtgtcagtcacagtattcctgagaaaggataattgatttgtaagccagttgataactagtttattattaagagaatgttgaacattgcattgtttattgggtcagtttatttttctcctttacagatattgaaaactcttgggctgaactgtggaatagtaatttcgaattaaatccagatcttcatcttccagctgaaaacaagtacataggtcagtaaaatagcaatttttatacataatccatccatgtgctaataggcacctgtatagcacattatattttacaaagtatcgtaggaatttatatttgagattcccagtaacattctgaggttggcattagtattttcttacttttccaaatgagaaaactgggggtcaaaaaagcaaagtgactggtacaagactattcagttggtgaataagaaaccaggatttaaacacagatcttgggactctgaagtttatgctttatcttgtatagagtagctgatcctttcataccaatctccttagggattgccattatcttgccagatttttctattgcttttcaaactgcaggtggcagcccattagaaggttgtgaagtcaatgtaatagattgtaaggtcagtgtaatgagccatgaaagcattaaaaaatcagttagaatagaaaatagcaaagtgtttcattgcatgtagaaataatgttattttaagaacttttgtttcagatatctgcctgtctactagcttgcagtggaaaacatatttctaagtgagttgcagaaaaaaatcattgaaagctaccaatcctaggtccaaggttttagagttgcttataactgtaatttactcagaacactgtatttccaagccattcattacatgtctaagtatatacccaaaataattgaaaacaggtactcaaacaaatacatggaccttcatgttcacagagcactgttcacaatactcaaaagatggaaacagcccaaatgtccatcagtggatgaatgtataaacaaattgtgatgtatacatactttacaatattactcataaaaagtgtagtactgatacatactataatggggaagaaccttgcaaacatcatgctaagtgaaagaagctagacacaaaaggtcacagataagtccatgtatacgaaatattcagaatagataaatccagagacagaacatagattgatgattgctaggggctgaggtgagtgggtaatgaggagcagtctcttaaggagtagggggtttccttttggggtgatgaaaatgatttggaactagctagaagtggtagttgcacaacatcgtgaatgtattaatgcttctgaattgttcactttaaaatagctaagtttatgttatgtgaatctccctttcattagggaaaaaaagccttttaaaaaagtattggccaggtgccatggctcatacctgtaatcccagcactttgggaggccaaggcaggcacatcacctgaggtcaggagtttgagaccagcctgaggaacatggagaaaccccatctctccaaaaaaatacaaaattagccaggcgtggtggcgcatgcctgtaatcccagctatttgggaggctaaggcaggagaatcacttgaacccaggaggccgaggttgcagtgagttgagatcgcaccattgcactccagcctgggcaacaagagtgaaactccatcacacacgccaaaaaaaaaaaaaaaaaaagtattaattatctatattagacacttcagtttcatatcttgaactgtaaataatctaaacaacccagttagcttattattttggttttctgagttagggttttactctgttgcccaggttggagtgcagtggcatgatcatggctcactgcagccttgacctgctgaactcaagcagtcctcctgtgtcagcctcttgagtagctgggattacaggtgcgcaccacaatgcccagctaatttttaatttgtttctagagatgtggtctctctatgttgcccaggctggtctcaaactcctggcttcaagtgatcctcctgcttcagccttctaaagtgttgggattacaggcatgagccaccatgcctaccaaatccagctcttttacctaaatatagcaagtactcaaattttaaaaattagctatttttcatctatgtgataatgaaactgttgttttaattaaccaaaaggacaagtttgactttgagcagaactattttgtaacttttcaaatgtatagcataaggttggtaaaaggcattctcatgaattaatggattgtttaataaattggtttatgaaactatcctgactaaaggctcctctctcagttaaaattgtctgtaagaaagggaatgaagcagaatgtgtagcaaccagaatcagttcttgggaaattccagatctttagaatttatttactttaagaccaacatagttttccctttggtattggtctactaatttaatgtattccaacatttgaatttggcttatttttgccacagagaaaagttacttagacttctgaagccaataacagattactggggctcctgctgaaatacttgagtgaattattattatcttcttttattagccacggactttacgttgaaggctttcgattgcccggaaacagaatacccagttaaaattgtgaatactccacaaggttgcctgtggtataagaaagacaacaaattcaaaatccccaaaggtaaaatgttgccctcctgttacttccctgctgaattccagtgttctctttagatgctctgtttcacatgtgattatctacttgctattttgatcttcctttgtggaggaggctggggctgggtgcctctatcagccaccttgatgccctctcaccctccctaaaaggagtaaaataagtaaaacaaatatttctccactttgctgtaacttgcttcccctgtgtatatcacctacttctctttccttttccccttccgtttgaagactttttctaggcttatctaccagatttatactgtcctcctatgctgtcacagaaatccttatggacactccagtgtccaggaaatgaaaatttaaggctagaatgaaatcgtttttagatttttttctttcagttaaatgaaagcagagccaggtatttggccatcttaaggaactcgtgtgatttgaacattgttgtttttaaaaagagataagaatacacaaaggaattattcatagacagatagcctagtccagcattacaaatgtgaaagccccaccaactgcctccttctaccatttttttttcagcataaaggaagcatagtatagagttaagtagactctaaagtccttatctttaatgttgtggccctaagtgtgctgctttttaccgttctgttcttgaacatggcataaggaacttattgaagccacatggaatcataggctgggtgctcttgtatgtcatttaacccatatccccaacctcaaaacacaactatattgtagctctgtgggattattgagtttattgggaagttattttcataattttttttgaatagcttatgagtttctaaaaatctcctcaaattcagtttccttggaaagcctctgctgtaaatttgtgtgaatgctggagttgttctcttaatgttcttagcatctgtcctctaaaaatttttcctgactgaagctattaataagagtatttataggcctctctaagtatctgcccttatgtctggtcttcccatagattaaagagtgccttttggaactctttatttggaatggtaaatactgctttttaaagacccttaagaataaagatgtaatgaggatttaaggattagtagtttacttcagaatttaaaaaatatatatattaggggaaaataacagatgtataaaatatctgaggcccctaaccttttttatctatggtcttttttcttttagcatatatacgtttccatctaatttcaccgttgatacagaaatctgcagcaaagtaagcaattgtctttttttctggaaaatacattttttagttattgaaaaactattttgtttcattctaaatcattctgtcattttctctatccatatttgagctatgttgctgatttatgtatttttttctgtactccaaacaagttatttgtattattaccaaacattaaaatggaactgtggctgctccattaccagcacccattggtaaaacatgctgatagtgtagactagagcaattagttcccagttactggatggggaaaagtccttaaagatcagtttgggtgagtgcccagtctataatgagactgatggatctgttgattctgtatttatagactaccaaggaatgtgattgttcctgttcttagcaaatcccttatatatttatgtagatagctttcattgtgggtggtcggagaccctaaagtgtatctgaacataggagatatttgggaaatgtgtctgaatataggagatacttgggaaatgtgtctgaatgtagttgatatttcggaaatgtgtctgaatataggagatacttgggaaatgtgtctgaacgtagttgatacttcggaaatgtgtctgaacctaggagatacttgggaaatgtgtctgaacataggagatacttgggaaatgtgtctgaacgtaggagatacttgggaaatgtgtctgaacctaggagatacttgggaaatgtgtctgaatgtagcagatacttgggaaatgtatctgaacttaggagatacttgggaaatgtgtctgaacctaggagatacttgggaaatgtatctgaacataggagatatttgggaaatgtatctgaacgtaggagatacttgggaaatgtgtctgaacgtagcagatacttgggaaatgtgtctgaacctaggagatacttgggaaatgtgtctgaacatagcagatacttgggaaatgtgtctgaacgtaggagatacttgggaaatgtatctgaacgtaggagatacttgggaaatgtgtctgaacgtagcggatacttgggaaatgtgtctgaacctaggagatacttgggaaatgtgtctgaacgtaggagatacttgggaaatgttggtgcatttcttctttcttttcctacgtaactgtaaaatccaaacttaaaatgacaagcagcactagaatttgttaatattcactctaaaaaatgcattcccaaactcatatttttaattagtcagaatgcctagacttggagggtagacagagccttcaggccagtgctgctgatgcctattccatttacctcattgtacaatataaatattatcattttgcatgtgtacatgacatgaaaaagattgggaaacactgctgaaggtaggaattctgtaatacacctctgaaactgaatcctgagtaagctgtattaccttttacattctggagtagagaatttatactttctaaaaatgaagctgcttactctaaattgaagcaaatctatttcatgtgtctttcttaccaattaaagatgccatttgcattttgtacttcttagtgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctgtaagtacaagtactctgttttccttatagagagcattaaaataccatatttatttagaggtttgtgcatgggatgctgtatagagaaataaatgtttattaatgtggattatcttgaatattcttggctgatgacagctattctaactgtgactgactatccataagaacaacatatgtttcattaattactggcagtgcatgggattatagcccatgctttaggattgatttcacttccctttgctgtcagtttctccacaaccaacactggcatttaggattggttctagctaaattttttaccatacaggaataaccttttttttttttttttttgagacagatactcactccatcacccagactggaatgcagtggtgtgatcttggttcactgcaacctccgcctcccgggttcaatcagttctcatgcctcagcctgctgagtagctgggactacaggcacgcaccaccacacccagctaatttttgtatttttagtagagatggggtttctccgtgttggccaggctgatctcgaactcctgacctcaagtgatctgcctgcctcagcctctgaaagtgctgggattataggcgtgagccaccatgccggctgtggaataacaaatttgactggtgttttgcctgaaatagagtagaactcaaatgcttgtgcccttacttcctcatcttatgctcctcattgtttcaagtatgtgtgtcttgtttcccttctaagtttatgaacctttccgaagcagggtctgtatcatgtcagttattaatctcttagtgagaaatatgttccagtattgcttcatcaaaaacttcataagaggaggaaaaaataatgggttgttagctaagagagttagattactgaataccaggtaaagcaatataatatactcaataataaattttatatctaggtttcttgggtagaatatatattatattaagatttagggaaatagggttatacaagaaaaattttagaggaaaggacctgccagaaagacctgtgctaggtgttaatagccttcatctgggcaaaaacccaagagaagagtatagctctcacctttttatgccttttcccttctccatctccccatggaacaaagattggtctcagaaggagacgccatcagtaaagaactatcagcggacattacattaactgataaaatgatgatcactgacatcagcaacaagccaagaataattttactttgtcagcctctgaggcctaaatataatgtagcttaagtttcaagcagattaaagcctaattcagtggttgtcatttggaaaatatgttttagaattacctggagagcttattaaaaatacaaaccatggaaaagtatttgatattcttgaatttgtgagacttagccttaatattaaaacctaatatataacatatatatatgtatgtatgtatgtatagaaaactagagatcaattttatctgtagaatatagatgtaaactttctaaaaattaaatccagtttagcaaaaagaataattcaagtaccaggaatgctagggttgtggaatattaggaaattgatgatcataagtcaccacaacacaagtcaaaggagagccactgtatgaatatagtgataaatgctgataaatcatttgataaatttgagttggcattcctaatacataggaatggaaggaaattaattaagtataaaaacctcagcctggcgcggtggctcacgcctgtaatcccagtgctttgagaggctgaggcgggcggatcacgaggtcaggagatcgagatcatcctggctaacacagtgaaaccccgtctctactaaagatacaaaaaatttgccaggcgtggtggcaggcgcctgtagtctcagctactcgggaggctgaggcaggagaatggtgtgaccctgggaggcggagcttgaagtgagccgagatcgcgccactgcattccagcctgggcaatagagcgaagactccatctcaaaaaaaaaatcaaaaaacctcaagtaaagaactatcagcggacattacattaactgataaaatgatgaacactgacatcagcaacaagccaagaataatccacaatcatctctattattctgttattgttttagaggttctggctattagagtaagatgaaaaaataaaaacttttttggaaaaaatatttttccttgcagatgatatgattgtattcttagaaaacctcatataccactaaaattaaaaaaaaaattaggtgtgatatggctggtcaaaagactagtatatcagaatcaatggctttttctcccccatagtaccagtaatcacttagaaatggaagccaggcacagtgggatgtgccggtggtcccaactcctccggagtatgaggcaggagaaatacttgagtttgaggatacttagctatgatcgtgtcactagcctgtgcgatatagcgaggctctgtctcttaaaaaaagaaagaaacaaatggatggaaacaatcttacatttatttacaatattgagaaaaaaaagccaataaaatggctaagaataaacaggaaaagtataggatctatctgaagacaaactacaaatcttattgagaacacccatgaaatgataaaaaaggaagaattgttccaaatttgacaattatttagaattttggacccttaagattctttgaggctaggaggctgaggcaggaggatcacttgaggccacgagtttgagaccagcctggcaacataagaagaccttgtctgtacaaaagcaaaaaaattagccgggcatggtggcccctgtctgtagtcccagctactcaggaggctgaggtgggagtatggctagagcctaggcattcgaggttataatgaattacagtcgatagtaccactgcactccagcctgggtgaccagtgatatcctgtctccaggtaacacccaaacaaacaaacgaacaaattgagttgttagtaattttcttatgtccccccacaatgcctagttccatgctgggtacctggtaaaaaccaaagagaaacatttccctccctaatacctagtggatttccatgcttcttaaaatgcttccttctttttcttttagctactgtttcagctcattattgactacttagctgagttcaattccacaccagctgtctttacaatgataactgagcagttgaagaagacctactttaacatcctcatcaagcccgagactttggccaagtgggtataaatgagatgagcttatattttgaggacctgaaagtattactctccctagtgggtgggtgtgggggttaaggctatagttgcagtgctaattttcatccgtgtttgaatcgtgctctagtttaggagacccgtgcatagcgttacggtatttctaaacccagcttatgtagctagctgtgaatgggactgaaagcagcttactgtagagactaaaagtaaggaagggtgttttcaccaatcattatacctgaatgttaaagaagtgctagttttaggccgggcatggtagcttatatctgtaatcccagcactttgagaagctgaggtgggaggatcacaagcctagaagttcaagactagcctgggcaatatagcaagacttcatctctacaaaaaattaaaaaattagctgggtgtggtggcacatgcctgtagtcccagctacttggcagactgaggtgggaggattgcttgagcccaggaggttgaggctgcagtgaaccatgatcatgccaccgcacaccaacctgcatgacagagatagaccctgtctcatagaaaaacaaacaaaaaacaaaccagaagaagtatttactggtgattttagtatgttggtgattagtagctgagttaaattgctaaacatgtcacttatctagcaatcttaactatccagaattcagccaagcttccagaagagagcagaaaggcagctacacagtctgtatgctaatacttaaaccctctgctcacaggcaacccccttgggccttcattcagagcctgttcttactactttagtccagggctaattgtagcctgtaggatacttttgcgtgaatcagaaaaaagtatccttctgaggtaccctctattagcaggtagagcctttgtgggagggagagaaaagtcctctgaacagacctacccctttgtgcacatgactggctagcccctacttgacagttttgccctgggcatctataaatagtgaacagcgtaaaggttctgcttttgacacagctgtaatgaacccatcagtttccagaattagaaagaaggggttaggaatcagtcatgtaataactgatattctgatcacagaaagttacaaaaactaataactagatatatgttagaaaggacatggacacagggagggaacatcacacaccagggcctgttggggggtgggggtgctgggggagggatagtgttaggagaaatacctaatgtaaatgacgaattgatgggtgcagcaaaactaacatggtacatgtatacctatgtaacaaacctgcacattgtgcacatgtaccctagaatttaaagtataataataaaaaaaggagagttatctgcaaccattgatacggtgaatagccctgccaataactcatgaatactactttatttatttataaaaatacattattaaacacaaccttctattttattaaaattcaactcctgaaatttactttataaaagaataataataaacctgtttgttgaagatttttgtgctagatctaagaactgttatataaattcattaattcaattctatccaaaacggttacctctcacgaatacttcccctgttttacaaatgaagaaattgaatcatagatgttagtagatttgtcaaattcaaacagcttatttggggtggggttgtggaaatgggggatgaagttaatctgattctggaccagagccgttacctgtattatattgtcactgcagtaatagatatcccaaatgatggcttctagtaattaatgaaatattagtgagatttcaaaccaaaatagtaataattttaaatcagtgtacaactaagtaaacttgactcatctggcagctttacttttatgtgaaatattttaccctgcaactgagacaggtaagtgcatttttgtactgctaagtaaatttgtttaaagtttgtgtatgtggttttcagtacttttttggttaatctgatactgttttcccatcttacattgtgataaaaatggtctctctttagaaacacatcctttatagaactttgaccaaacatttctttattctgaagattcatttctaataacaaaactttgagtgttttttttctgccctctgtacagagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagtgagtgtgagatgctctgtaggccaggtctgaatgcagttgtgaactctggaattgccatagttctttcctaaaggggaagctgtagttttggcaggccagcattatcatattctgtttagaagggaacctgacccctctgatgctgggcagctttcttcttaagatgaagactgctgggctgggaatgatggctcacgcctgtaatttcagcattttgggaggccaaggcagaagcattacttaaggtcaggatttcgagaccagtccaggcaacacagtgagaactcatccctacaaaaaataaaaaattagccaggcatggtggcacatgcctatagtctccgctacttgggaggctgaggtggaaggatcatttgagcccaggagtttggggctacagcatgctatgattgcaccacagtattccagcctgggcaacagagtaagaccctgtctcaaaagaaaagaaataaagaaagagagagagaaaaatagattgctggtaatagactaggattttgagtgaaatgggtttggcgtatctatactgtttgttacctttgttgaagattgtatgtggaaaccatgaacagtttagtatagaggctaaaatgggaggaaggaaatggtgagggatgtgtgtgcatacatacggatacatacatagatacatacatacatagccagaactagtatgtcaagcctgtttgtgaagctaaggtgctgggctttatcctgtagaaatggagaaccattaaaggatttaagaagatttgtggttaagaaatatccagagagacaagttatgaagctgttttaaagtacagatatgattccactcataggagttatctaaagtagtcaaattcatagaagcagaaaatataatggtggtttccagtagttggggagaagagggaagagacaagttattttatgggtacagaattttggttttgcaagatgaaaaagttctgaaaatctaatctactgcacaacagtgtgaatatagttaacattattgaactgtaccccttttttttctgagacagagtctcgctctgtcacccaggctggagtccagtggcgtgatcttggcccaactgcaacctccacctcttcggttcacgccattctcctgcctcagcctcccaagtagctgggactacaggcacctgccacctcacccagctaattttttgtatttttagcagagatgggatttcaccgtgttggccaggatggtctcgatctcctgacctcgtgatctgcccacctcggcctcccaaagtgctgggattacaggtgtgagccaccgtgcctggccctgaactgcacacttttaaaaatggttgagattggccaggcgcggtggctcacgcctgtaatcccagcactttgggaggccgaggtgggcggatcacaaggtcaagagatcgagaccaacctggccaacatggtgaaaccccgtctctgctaaaaatacaaaaattagccgggcttggtggcacatgcctgtagttccagctactcgggaggctgaggcaggagaattgcttgaatccgggaggcggaggttgcactaaactgagactgtgccactgcactccagcctgggcgacagagtgagactcctcgtctaaaaaaaaaaaaagttgagattataaactttatattattttatcaaaataaaaagctggagtgaaggctgtgcaaggcggcccacgcctgtaatcccagcactttgggaggctgaggcaggcagattgcttgaggccagggattcaagaccagcctggccaacatggtgaaaacctgtctctattaaaaatgcaaaacttagccaggtgtggtggtgggcatcttgtaatcccagcttcttgggaggctgaggcagaagaatcacttgagcctgggaggcagaggttgcagtgagccgagatcacgccactgcactccagcctgggtgacagagtgagagtctgtctcaaaaaaaaaaaagagttgggagtgaaaaatattgaagcctgatgttaggccaaataaatgaaaaataattgcttaaggctggacatggtggcttatgcctgtcatcccagtactttgggaggctaaggtggcagaatcgcttgagctcagtagtttgagaccagcctgggcaacatagtgagacaccacttccaaaaaaattaaaaaaaattagctgggtgtagcaatgcacacctgtaatctcagctacttgggggctgaggtgggaggattgcttgagcccaggaagtggaggctgcagtgagctgaggtcatgccactgccctccagcctgggcaataaagcaagaccctggtgtttttttttgtttgtttaaagaagtgcttaagaaatagaagatgatggaaattcactcagtgggagtgagagagaaggcagtctagaatgatgcccagatttctttcttgaagcagtgggttggtggaacaggaacagtagtaagagtgggagcatatgaggagtttgttctgatacgtatttagttggaaatgtctgtggggccttgtacctgactaaggccttttcctcagtcagatgcttgttcaagattctctccctgaactgttttgttattaaccatcctcctccatgccttcccagtttctcagggctggccctttgattggaatatataaatggccactcttgaaattgtggctgctatcctcccctttctctctatcttcattctgcaaccccagaaccagccttagtttctgtcttggccaccaaaagaatcttaagtctcagtccacaaagggaagagaagaaataggctgcctgtttttccgagcaccgttgaagtaccaggcaagggcttttgatacagagtccttagtaccatgaatttcctccagtagaaatcactttagagaagagctaatccctccatttatcccttattttatagataagaaaacagaattcttaagaagggaagaggatgtattcactcagtattaaatgttattttctttgctttatccaggttctatgtcaatgggcccaggattctgaaacatagtccatgttgtcataaaggccacagcctagttgggtaaaccaacactgaacaattaagtttgatccagttgggaaactgtattatgggtaaacagattgccaagagagccagaacagttaagagctgcttagtgttccacaaacacaatcaatcttgaatcagtcaatgaataacttgccagcatttaggtcaccaactatatctgctttcctaaagctatgcagggctccccaagcaattggaacattgatattagctgattctgggtgaaatgaatgtctagagagcttaatgtagttattctcttttgcctcttaggaatctatggatttcctgaaatatgttgttgagtaagtatttgaattttctctttggggttatgtgttcttaccagcgagagggcatggagccacaattcagttaattgttactaaacacccaattgaaatactacttgtagtagatttttttgaggctggtgtacaaggcaattgaaaagttagaaggcctagcttcttatagtttttgggtgcctcagtgacccatactgattctcttgcagcaaactaaacttcaagcctctggagcaggagatgcctgtgcagttccaggtggtagagctgcccagtggccaccatctatgcaaagtgaaagctctgaacaagggtgatgccaactctgaagtcactgtgtactaccaggtcagttgggtgtactaaagactggcggaaggcccagtgcctggggatcagggaccccgtgaccttcaaggcccttttatagttacttctgtagtttcatgcttggggccatttgtcctcttgaagcaactacatttaaaaattgctcctgttggtaaaatggatcctttttcaatcacagtgaggtattgcttcattaatcacctaagtactaatctagagggccagaaaccgaggtgtgggtggaaatccctacatgtgcccctgatagaactcccaagtagcagaaggacatttgttaaggggcagttttgaaaagaagacagaagtaaacatagccaaacaattaagacacagcaaagagaacgactactagagtcataaatgtttaaagcacctgagaggaaggatttatcacctctgttttagggtgacaactccatgatccagagccccttacttcttgaggtcgtaccagctgggtctcagattattccttttgtcttcagattctgtgttctttccacaccattctactggggtgtgtggtgcttaaaggaaggaagcacgtggcagtaatcacagttagctctagcctatagcctgctttaacctgtggttggtcccactcgcttctagaaccacggggatcttccttaaaccttgcctgtctagtctgattactgactccccaaattctggggctcctgtagccgctgctgttatcttgggttccctgcatcaggaattcacttctttgtcaggtcttgtgaagatccctgactgggctttgggtgggatggactgattatcatttctttgtcttgtatctctgcccctgggcctcagccttattctgacattatcctggtctggctgtcaggagcaaattcacttgcccgatgtcacggtcatctcttgttagtgaagttgtgtcttgtcctagtcttcttaatgagtactttgattcaggagcaacagcacttttggagctaggttgataatatttttgtccttccgtagaggccctgcttctctctggagcctctgtggctgtagcattccaacctgcagcctcttctaggttatgactaccaggtcccaaactccacaaatggtacagcctagcctttcttaacctagtctacattttcagtgcctctgactgcttacaaccccggtacaggagtactcattttcggcaggatttcacattgtaagactatgtttatagaaatgctttccatcagtcacctcttagcactagcttctaatacaaactgttcccttttggaaaccatatcctttctcagagagcattggttttgttgtggtctgtttagagggaaacagaaaatctcaatgctgactaatcaggtcttgcaagggcacataggcattagcctcttcctctggtgagtgggaagcaaatgagtctgtgtgagaggaacctgcaagatcctgactctgggaggcactagcaacatccttgtttattggcctcctgtcctttcattctgaatgcattattttgccagtcttgggcagctagcatgtggtcccaaagcgtggcttctttctctgaagtatttttcttatcaactggttttggtccttttatgtggcactggttcttgttgtgtggcactattcattttctctcctcttgaggaatagatccagatacatttcaggatccccaaacatttcctgctgtcttccttagggctttgagttgcaagtacttaattttagaatgtgtcctctgacaggatctggcaggtcagggattattaatctcacctttgtttgcacctgcaattctatgctagtgccgggagtacaaatggtcaagcatgactcctgtcctcatagaccttcagtctggtgggaaagcagatatgtaaacaacatcaaagtatgattaactctcttgggggagagcgattggtggtgatacctaagtggttgcctagaatagctggattatttaaaagccctgtaaaccactggatattcagttggcctgacaaccttctcttttcagtcaggtaccaggagtctaagagaatatacgcttatggagctgcttgtggtaagtgcataaaggagatgctgaggttttcagcagcccctgacccactatgaggcccggccttttctgcctgggttagggacatggggtagtcagagatctgtgatttgaaggtgagatggtcatttactgttctcacccagtataagcctgggccaattaggaaaaaggcactaagggaggctggacttgggaggtatgtgaaacactctggggagagaaatggaggtttctctgctgggaggagttgggctgatgggcagtatgttgaattacagatgcacatggaagaaccttgttttgacttccttcgaaccaagcagacccttgggtaagtcagctggcagggccactgagctcaaataagggcctagggcttactttgcaggctgttcatcagatatccctactgagcagcctgttagagcttccttccatctcatagggtgatatttagtcatccaaacttttggaatttgtatctttgactgtaatcaggttttcagtttggtcaagtttcaagataagaaaaaaggctagtttgtggtccccaattcaggagaggtatggacaccttaacatttttgggtcctgtttcaggacttccagttccaataaggatgggcagaaacttttcccactcctatctagtgcctccaaggccagggcccagatgatcacctgagctcatataacttttctctctggcttgtaggtaccatgtctaccctacctgtaggaacacatccgggattctaggattttctgtcactgtggggactcaggcaaccaaatacaagtgagtgagtgagtgaatagatgagtgtaacctattatggacatggagagtaggggctacatgtgtttccttaaaccttgggcaaccctgaccaagcaggtttgctctatttagtcagtggaagctgggaagatgggggttgttatagatggtctgttccaggactgatcaatagttccagtggccctttcagacttgattcaagtcctgtggtcattgtgtggggcttgccagtgtttcttctcttcaggcagacctgaggacaagaagggaaaggatgcctgatctgacaggcattgctgaaacctgttagttttcagctttggaatggtcatacatggttgtgactgcttcattatgaggataccaggaaactgggctggaggtggggtgagggggagggttctttctctttctgtcctcaaagtcaggtggaatactgaggcctgggaaaacactttagctttttttcctggatatatgtcttagtcttaattccttcttttgccttctgcctgagatcgggtttctgatgacttaattgaagatgttttgttttagttctgattgaagatgttttgtttcagttctgaagttgttgataagaagatagaagagtttctttctagctttgaggagaagattgagaacctcactgaagaggcattcaacacccaggtgactgtgccagcctggtcttttggcctttggcccacacaagcccccagatacaaatcttaacagggcttcgccggccagtttttgagctttgcagccccaccttcctcttacaatagtgtctccctagcttcatccgtgcctcttatactggcatgtccatcacaagccgggctggacagggcccagtgtgttctgtgggaagtggtatgttgcctcacctgagcatctttctttttggtgggaacaggtcacagctctcatcaagctgaaggagtgtgaggatacccaccttggggaggaggtggataggaactggaatgaagtggttacacagcagtacctctttgaccgccttgcccacgaggtaacatggttttcagagtaagacagctcaaactggtcaaggttcctgattctacaggcatcacaggtctgtgcacaccagcattgtgtggaagagaaactcgaaacactagtcctggcctgattactcgctcacttcctgagttttcagactggcctctctagcaccttaggtggccacgtgagctgggtgctaatccttaccacaccaccaccaatttcaatcagagcagctctatttttatgctatatattgaggtctacaagattttgtggagaaaaagagttttgccgtttaaagaaaattgaggactctttgtctttacggagttcattattccaagtgcatgtgttttgacaacttctattccaaagtagtaaaacctatgaaaaagatctggatcttgtactccagtgtgactttggttaatacatagcccctacatggtgaattaccataggacatcattgctctgtgatgtaaagaggttatttagtaagaggcttcatcttaacacattttagttttcttaatagaagcaaggtagatttcctcaagccgtggtatgcagctaccatgtaattgggaggtgacactaaggggatgtgggtgttgggctcagtgtatggtatttagctgtaattatagcatctgctaacctctcttgccattgtagatgattggtataaaatgtgaaggcatgccagagagcttcatcatcgttttggtctggaaggttaggggtaacctgagaataggaagaataaaatgaggtcttcagatgctaagcaggtccagggacatctgcctgggggttaggtttaagagctatctttcttcttgaatttctttcctatcttcccttcccttgtaagattgaagcactgaagtcattctcaaaatcagacctggtcaactggttcaaggcccatagagggccaggaagtaaaatgctcagcgttcatgtgagtatgtttaactaactccatccattctagggttgtcatttactgagtgagtttgggtggttatcatcagaactcttaaacccctaaatctggtcagcatatttttcacttttgtctttgtcctctttcaggttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgtgtattttaaaatgtgtttgtttgtattttatggagttagttatactactgccttagggcttccattgaagttttgcactggcatcatagcatttgatttactttttatcctttgttgagactaataaacccagggttactgtaggagctggcaaaggaaaattagcagaatgggccaagcgagaccagaaagcctgcagcagcactttgagaagccctggcctgtgtcctctcagactgagaatctacttcttgaaaggccttacgtaaccagtatattgaataactaactaaatgctaggtactaatacctgtttttttaatgtatttttaaataaaaaagatgatagatagatagatagatatagttctgtatttcccttcagaatgagccatctgctgctgtggcattcattttattctatctatctatctatttttgttcactgtggggtggggatctataaatacacactcttcccaaaccctctaaggcaataaaacatttttggataaaatgt

SEQ ID NO: 12952 - DNA, 510 bp, Homo sapiens
gtcacaattcttggcaacaattccagaaacggcaagtctcagaaacatgtcttgtctttatgtttgagatcctttaataaaagcccacattggtattaacactcttcctaatcattaaaaaactgtacttgaaattataaaataaaaaaacatcttatttatgcaagtaaattcatgctaactggcttttatgagccagttaacaggtctaaagaaagattattctattattaatagattatcatacctgtgatcataatttaccgatggaagtgtgtgtgtgtgcgcgcacacgcacgtatatttatatttttcttaagagacaaggtctccttatgttgcccaggatggactcgaactcctggcctcaagtgatcctcccacctcagccacccaagtcactgggtttacaggtgtgagccaccacacccagttggtatttgtatataaataaaggaaaaataaaaaaggcacacaatttacttattaaatgtaaaaattgaaatcaaa

SEQ ID NO: 12953 - DNA, 7927 bp, Homo sapiens
acaaagacagaaccattctttcacactcctaatccagaagctgtagttcaagacaaaaggcagttatttcagaaaagcataagagctctaaggcagaaaaaatacctacaaaatctcggcagtaattctgtgcttcttgcccccatagaagggtttagtgtggaagatgatatttgcactatagcctgttttggaacaattaatattgcattctcctcctaattccacccagggcactgtgaggatagacctgcaaaatcaaaagtttttaggtaaggttgacagttaagaggaagagggggaaggggcatgtctcaaggaacagcagagtctactgctgatcagaggaaatggacacacttgccttccatagccattggggaatgtgagaatgtaatgttcatcatagtctagacatgagacacagcctgtggagagaagggacagaatctctgatgagtagtgccaagtggccacaaggctttcttgtcgagctgatggttactccaggatactccattcaatttagggataacctatctagttccccaccctttgctctcacccccaataccaatgcttagttgctaacaatgacatctagtctagccattttcataaaattctcctataacattgtagtccacccaatgccaacacacttaccctgccctatgttgtgcaccccaattgacatcccaaggaattttgatttggtccagatatgagcattgaattgtatcttcttgttaaaacactcagcataaaaggctgaaactgaatagaaattttcaattagtagattatatatacctacagccacctctccaaaatcacataacctggggaaataattggcttcatggggaaatcctttacccttcaaacagcctccaattacgccaggaggtacctacctgccttttatacccttttccccaatgcaagcattcattcagagccacgtgggcaggatcatccctgaaatgatgctgtggccaacccaggaagcttaaaaccaaaagggctatctgttctggtctgcaagtacacccaggctccagccccaacctaggcccagccagtgtttccagttttaatactgcactaaacaaaccagatgttgagggtatgtacagttgaccctccatatccatgggttttgtacccacagattcagccaactgtggatctaaaatatacagaggctgggctcagtggctaacgcctgcaatcccagtactttgggaggccaagacgggaggatcacttggggccaggaatttgagaccagcctgggcaacatagtgatacactgactctaaaaaaaaaaaaaaaaaaataagaaaattagttgggtgtggtggcacatgtccatagtcccagctaactgggaggctgaggtgggaggatcatgtgagcccaggaggctgcagtgagctatgattgtgccactgcattccaccctgggggacagagcaagaccctgtctcaaaagaaaaaatttaaaatccaaaaataaaaataatacaaataaatagtgaaacaactatttacatagcatttacattgtattaggtattataagtaatctagagatgactcaagtatacaggagggtgtgcataggttatatgaatataaaagacaccattttatgtaagagacttcagcatcctcggttttggtatctgcagtatgccaggaatatactgtgtagaaactacgtatcacttatataaactgtctcacagttgctgaggtctctacagcacaaattactatatataagatgactctggaagcattaaaagttggtttcctaaatcccttctttttatacgcacttaatttgtgaagctaagagtctggagcttacaaaaggaaaagatatgaggaacaaatcaacttgagtttccacttcagggaataagaaacacacagctagtcacacaactgacagtaccctcagctatggcgcttttaatgaccctctttagacagaatagttttgagagcacaggttgcagaggagctctgtaacttactgggtggatgatgggaaacctgctcagccacaaatgttacactgtttttggaaacccagggaactggtccttctgaaactagttcctgcaagcaaatataacataattttcttttgatgagaaaacacaaatgacatttcagagaatctggtaattggggtctctgctcgctctacacacaccaagcaccctatatatatatttctattgtagaacttaactacaatattttaattgctttgtgtcagtctccctgactagactaagacattcttaaaggcaaggattgtgtgcctcattcagggctgacaagagtaggcacttatcaatgtctgccaaatgaataagaacagacacatacttgtctgtcttcagtatggactatacgtagtgcatcacttggagagggaaatatatggagaatcatgtttactgacagattattatgtgtcaggtgctgtgggctatggttttgttttttttacttcttaaagcctttttacatgcatttgagtcttccctgctggtcattttcttcaaccactaaatttgttggagcctcagagccagttctgggttacctactcttctgtagctatgctgtcttcctaaataattttatccaatcctagagctttaaaatgtcatctaaatacactatactctttgaaagccccatccccatctcagacctctccctaaactccacactcttaaattccatctccctacttgacagcttcacagacctctaaaactttatattttatattagcttttgatttttccctccccaaatccaatcttttccttatcagtaaatgacactgccactgcttacatccacatgcaaggattcatctctgatgtctcctttcccttacctcccccaatccatcaatcagttctacctccaaaataaagcttgaatcaccatgtctctcttggaataatgtcaaaacctccacaatggtcttcatgcttctatatttgccccttctcaatttatttttcacaaaatcattctattgatcttctcaaaacaaaaatgagatcctgaaaagccataaaattatattatggtctacaagaccttgcaagatctgatttctacatccccatcctcatctcatcctactctttttcctccttctcactacattcaaactatgctgctctaacaacaatttcttctatgggtggtgaccatcttttgatcattgctttcatcattattatttgcccctaaataaaatcttgaatcagtatacaattaagataatttaaaaatgtcaatgcagaactcactgtgttctcttcagtatcatttggtaatgtccaatgacactgaaaaatctcgcccaaaatgggattgtatggctttttggcaactgatcctttccttcccgcatgaaaggctgagaggtaccatttcacaacctgaaccattcgatccttgggatccttctggtcactaatgctgcaagggagaaagacaaaatttaatgtcctgctttctggtacaagacaagatgatgcaacaacccccagcatggtccacctaagtcaggctgagaggactgaggacctaggaccaggagttagcttacagtttcattttaaaattgagtataatatatataattaaatgcattggtcttagtggttttttcttttttttttaatttcaacaggtttttggggaacaggtggtgtgtttggttacatggataacttcttcagtggtgatttctgagattttggtgcacccatcacccaagcagtgtacactatatccaatgtgtagtcttttatccttcacacccctcccacccttccccttgaagccccaaagtccactgtatcattctttctttttgagacggagtctcgctctgtcacccaggctggagtgcagtggcgtgatctcggctcactgtaacctcacctcccaggttcaagcaattctctgcctcagcctcccgagtagctgggattacaggtgcttgccaccagcttggtttttcattcctgagtctcttcatttagcataatggtttccaactccatctagattgctgtgaatgccattatttcgttcctttttatggctgagtagcattccacagtatatatatgccacgttttctttatttgcttgttgattgatgggcatttgggctagttccatttttgcaattgcaaattgtgctgctataaacatgtgtgtgcatgtgtctttttcatataatgacttcttttcctctgagtaaatacccaggagtgggactgctgaatcaaatggtggatctactttcagttctttacggcatctctattctgttttccatagtggttgtactagtttacattcccaccagcagtgtaaaagtgttccctttccaccatatccacatcaacatctattttttttttttttaatatggccattcttgcaggagtaaggtggtattattgcattgtggttttgatttgcatttccctgataattagtgatgttgagcattttttcatgtttgttggccttttttttttttttctttttgagatggagtctcgctctgttgtccaggctggagtgcagtggcgcgatcttggctcactgcaagctccacctgccgggttcacgccattctcctgcctcagcctccccagtagctgggactacaggcacctgccaccacgcccagctaatttttttgtatttttagtagagacggggtttcactgtgttagccaggatggtctcactctcctgacctcgtgatccacctgccttggcctcccaaaatgctgggattacaggtgtgagccaccgcgcccggccaaccatttattttattatcattatcttcttttgataattgtctattcatgtccttagcccactttttgatgggattatttgtttttgtttttgtttttttttcttcctgatctgtttgagttccttgtagattctggatattagtcctttgccagatgcatagtttgcgaatattttctcctactctctgggttgtctgtttactctgttatttcttttgctgtgcagaaactttttaatttgactaagttccatctatttatctttgttgcattcacttttggattattggtcataaagtctttgcctaggccaatgtccagaagtttttccaatgttatcttctagaatttttatgattttaggtcttagatttaagtctctgatatatgttgagttgatttttgtataaggtgagtgatgtggatccaatttcattcttctacatgtggcttgctagttatcccagcaccatttgttgagaagggtgtccttttcccactttatgtttttgtttgctttgtcaaagatcagttggctgtatttggctttatttctgggttctctattctgttccattggtctatgtgcctgggtcttagtgttttgcttgaggatttgacaaacgtatatatctatttaattaatcgtcacttaatcaaaaaacagaatatttccattaatccagaaagtttccatatctccctttccaaacaatcgccacatcttacttactctgaggcaaacactgcttctggtttctagtatcatagattaagtccatgtaagtgcattgcttaattgccaaataattggagattttctgtatgttatcaattactaatttaattcatgggtgtagaatatacaccctgtatgattccaattattttaaatttattaagacttccctatatatgttctatcttgataaacatttcacatgcacctggaaaagactctgtgttatacaattgttgggtagtgtttagaaaggccaactgggtcaagttgatttgatatgctgtttaaatcttctatagccttcctgattttttgggggggcggggaggtggtgaaggcagaggctacttgcttcatgagaccctgacggatgaatttgtggacttggctatttctctttttagtcaatttttgttgctgcatgtattttgaagctgtgttattaggtacatacatatttaggagtattatttattcttgataaatagatgcttttatcattacaaaatattcctatttgtctctaataatatttcttgtcttaaaagtctcctttgatacttatacagatacaccagtttttgctatgtttagtgttttgcatagtatctcattttccatccttttacttttaaccagtgtctttaaagtttctctcttgaaaatatcatatagataaatcctgcttttttaatccagtctgacattaaatggagtggtaactgttgatatagttgggattaactctaccattttaataggttttctacatgccccctttgttccttgttcatgccattatttctccttttctcctttcttagaattaatggagtatttgtatgattccgtttaatcttatctactggcttttgaactgtacttttattttttttaagacagggtcttgctctgtcacccaagctgcagtggtgtgattatagctcacagtcccagcctcaaattgctgggactgcatgaccctcctgccttagcctcccaagtagctggaactacaggtgcacaccaccaagcctggcttattattaaaaatttttttttgtagggacagggttgtgctgtgttgccctggctggtctcaaactcctggcttcaagcaatccttctactttggcctcccaaagtgctgggattacaggcatgagccactgcaactggcctgtaaatagttctgggggcctcaaagtttaaattctcacacataaaaactacccttaaatctcaaatctatacccaatgaacaactggtacgttccatttttgcttacacgttactaataaatgcttaaattttacttcttaaattatctgttaatttaaacactgccatatttatttaaatttctgcctttggggaattggttattcttttaaatcttcatcaagaaaaaaaaaatatatatttatcaatgtcagccaatgtatccacccagcaagaaacttcagtgatatgtatctagcttcagtaaaccacagtctgagactaaggaatgcagagaagacgaactaacaacattccccattacaaaaaaatttcctgctaccagcgaaaggcaatgtgaactcacctccttgtaaatcaatttcacctttacattacttctatctcatacatatacacatatataatattgcaagctttatatttaaaatttataaatcatctataatttggatactatattgtaagctcaagggcagacatgacttttcctttctccaacttgtaagaaagtgcctagcaaacaacaggtgctttggaaaggtttgctgaactcagaaaattaagcttcattaggatatagtacaaataatttgacagtgattgccagtgcctggattaaataaacttataccattggccttgtgaatattggctacctattaacgggctcttgagaattttttaaagtgttaaacttggttgcctaacatcgccaccatataactttaagcaaacaggcaaccagtgtaaacacattattcaataccacagaatacccagaaatgtttgaaaggtgacaaggaatccatctatcctgcaaaataaaaggcagaaagctgctgagtaacatctgtaaacgttggaaactaccatgttcagtcaaatacctcacaaacaggtccggatgtgcaaaaaagtctgcatacatttctaaaagagatcttctttcaagaataaacgttggaagaactacctgaaaaacatacacatttgacccttgaagatcaaatttctcttcagataaacagactaaaaaaaaaa

SEQ ID NO: 12954 - DNA, 1836 bp, Homo sapiens
gctccatccaacacctgggccgccttccttccccccagtcagagctcagacagtaggagctgccacaacgagatctttattaggctcctcgggggcggggcgcggagggaaagaaggggtggccaggcccaggccaggctgcaggctttggcgacctctcagagctgggagcggggtcccgaaggcgggtctgagggcagagcagagtcagaggtgtctatgggcgtccccgacctcccaggctgccccgtggtttcccgccctgcttgggggtgagcgggggttagtgggcgggttagtctagggccggggccgccgcacggggcgaggccctgcttaccagtcccggtcagggtgggctgcgggagcctcaggctggaaggcagaggacagtgagagcccgcccccagggtggaccggggcaggggcgggccgtggggcggcgcggggcacgtacccacggggaagtagtgggggagccggctccggtagatgtcctcgtccttctcgaggaacacgcagatgatcagccggtccacctgcgccaggggctgctcagcctgggccgagctgccacgcctggccccaggatcctgtgactgcctgccctggtgcaggctttcacctgcctggccctgcgcccttcacggaggctcacggctgtgtgccatcacccccatctcgccaccgccagcgcccttgcgcaggagaaacagggaaggaaggggcgggcctggccctgcgctctgcaccctgactccctgggcgatgatgggggctggtcactctggccaggatgcggaccccaccctcgcccgggcccaggactcaccttgtccttgtgctgctccagccactctcgcagcgtggccagcacgatctcggcggccgcctcacaggggtagcctgaggcgggtggggcgggagtgagtcctaggctctggccccgcccactcccctgtccgccccggcccctcccggcgtctgggtccaccgcccactcctggtccttgcctttcttccagactcaccaaacacgccggtggagatgcaggggaacgcctgggcggggaggggtgagagggggttggaacattgtcactgcgccccgcctcccgccctcccccgcgggccgtccctcaccaccgagcggagccggtgctccagcagcaggtccagactgctcaggtagcagctgcggagctcggcagcctggctggcgctgggctccccgtaggcgatgggccccactgtgtggatgacgtctacggggggcgacggggtcagaccggcgggggtctacgcggtcctcagctccctcgcttccccctgccggcctgggcagaagggggcaggaaacacctttccccccaagcgctgagcctcctccgcgaaggcccccacccctgtgggccccctcgagcccgaatccgcacgcgcacagagccccgcgccccctccccacatctgtatgggcccggctgagacccgagcgcgagtgtgggcgcgaaggcgttgccccccagctccatcctcagcctccacgcacggtctcccccatgtgcttcctggggtgtgcggggtgggggccgggtcttggcccttaaggttaagaagggccccctgaggagttccccagcactcctgtgggggccgcagccctgatgtcccagtgacacacgggcgccctgtctgcgccccacagctgggggcgcgtcggggactcacacttggccgggagccgatagccgccggtgatcttggccttgccagtcttacagctctgcagggtccggcactcgtcggtaagcagggggccggcggcccgatgaatgc

SEQ ID NO: 12955 - DNA, 1837 bp, Homo sapiens
gctccatccaacacctgggccgccttccttccccccagtcagagctcagacagtaggagctgccacaacgagatctttattaggctcctcgggggcggggcgcggagggaaagaaggggtggccaggcccaggccaggctgcaggctttggcgacctctcagagctgggagcggggtcccgaaggcgggtctgagggcagagcagagtcagaggtgtctatgggcgtccccgacctcccaggctgccccgtggtttcccgccctgcttgggggtgagcgggggttagtgggcgggttagtctagggccggggccgccgcacggggcgaggccctgcttaccagtcccggtcagggtgggctgcgggagcctcaggctggaaggcagaggacagtgagagcccgcccccagggtggaccggggcaggggcgggccgtggggcggcgcggggcacgtacccacggggaagtagtgggggagccggctccggtagatgtcctcgtccttctcgaggaacacgcagatgatcagccggtccacctgcgccaggggctgctcagcctgggccgagctgccacgcctggccccaggatcctgtgactgcctgccctggtgcaggctttcacctgcctggccctgcgcccttcacggaggctcacggctgtgtgccatcacccccatctcgccaccgccaggcgcccttgcgcaggagaaacagggaaggaaggggcgggcctggccctgcgctctgcaccctgactccctgggcgatgatgggggctggtcactctggccgggatgcggaccccaccctcgcccgggcccaggactcaccttgtccttgtgctgctccagccactctcgcagcgtggccagcacgatctcggcggccgcctcacaggggtagcctgaggcgggtggggcgggagtgagtcctaggctctggccccgcccactcccctgtccgccccggcccctcccggcgtctgggtccaccgcccactcctggtccttgcctttcttccagactcaccaaacacgccggtggagatgcaggggaacgcctgggcggggaggggtgagagggggttggaacattgtcactgcgccccgcctcccgccctcccccgcgggccgtccctcaccaccgagcggagccggtgctccagcagcaggtccagactgctcaggtagcagctgcggagctcggcagcctggctggcgctgggctccccgtaggcgatgggccccactgtgtggatgacgtctacggggggcgacggggtcagaccggcgggggtctacgcggtcctcagctccctcgcttccccctgccggcctgggcagaagggggcaggaaacacctttccccccaagcgctgagcctcctccgcgaaggcccccacccctgtgggccccctcgagcccgaatccgcacgcgcacagagccccgcgccccctccccacatctgtatgggcccggctgagacccgagcgcgagtgtgggcgcgaaggcgttgccccccagctccatcctcagcctccacgcacggtctcccccatgtgcttcctggggtgtgcggggtgggggccgggtcttggcccttaaggttaagaagggccccctgaggagttccccagcactcctgtgggggccgcacccctgatgtcccagtgacacacgggcgccctgtctgcgccccacagctgggggcgcgtcggggactcacacttggccgggagccgatagccgccggtgatcttggccttgccagtcttacagctctgcagggtccggcactcgtcggtaagcagggggccggcggcccgatgaatgc

SEQ ID NO: 12956 - DNA, 645 bp, Homo sapiens
ggcgcagcgggaggcatggaggaaacgctccagcagcccaacctcgccagggcaccgcgcaggagaggcgcggcctcaggcaggcctgggtccagcccgggctcacccctcatcggctgtgagatcctgccccttcccctctctggcgtccaccctcttatctggaataccgggacagcgaccctcccacagaggaaaacgccgcgtgctggccgggaggacagggcccatctttggcagctctgatcgcccacgccaggagctcctcaggcaccagctgcctggtgctcacaggcgggcatcaagagaggaccatcattccccattttacagatggacaaaccaaggccaccttctccttcatcacctcagtctcggcacagttccagggatgccaggtagctcacacccctttcttttgctgtttgatctcgtgccctgggggcacaattaaacctcattctgcaactttactcagagctggcaccaggcaatttcccagagcgtcccagggatgggtgggcagagaggttaggggaacgctgagaacggctcaggcctggatcccttccacctgctcctctcctctgcagggagaaaggcagctgtagcccagggcgaggctgagatggagcaagaaggcag

SEQ ID NO: 12957 - DNA, 1918 bp, Homo sapiens
aggacctccacaaaaagtactcgtacatccgcaagaccaggcctgacggcaactgtttctatcgggctttcggattctcccacttggaggcactgctggatgacagcaaggagttgcagcggtgagaagggtgggcactgggcaccgaggcaggtgggtgtctacctcctccccgggcgagtaggatgtgtctcgagtagggtgtctccctccttcccgggcgatgggctggactctggccttgcaggcggggcagtgctgtctcggccctggcgtctgggctggtcgaggagcccatgctggcccacctttccatcccacccccaggttcaaggctgtgtctgccaagagcaaggaagacctggtgtcccagggcttcactgaattcacaattgaggatttccacaacacggtgagccctggtgcctgtcttgggctgggccatgggggaggggttcacctggtgaggaccacccatctcctccctgtcatcttgccctttctccctccgtggctgcagttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggtgccgtccccctcccctttactctcggccgggggagtgcagtgggccacagggcctggggcggggtgcggagaccagggcctgaccggcacctgtgccacaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgaccccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccgcctctgccgtccgcctgtgcctctgcccgcctgg

SEQ ID NO: 12958 - DNA, 1920 bp, Homo sapiens
aggacctccacaaaaagtactcgtacatccgcaagaccaggcctgacggcaactgtttctatcgggctttcggattctcccacttggaggcactgctggatgacagcaaggagttgcagcggtgagaagggtgggcactgggcaccgaggcaggtgggtgtctacctcctccccgggcgagtaggatgtgtctcgagtagggtgtctccctccttcccgggcgatgggctggactctggccttgccaggcggggcagtgctgtctcggccctggcgtctgggctggtcgaggagcccatgctgggcccgcctttccatcccacccccaggttcaaggctgtgtctgccaagagcaaggaagacctggtgtcccagggcttcactgaattcacaattgaggatttccacaacacggtgagccctggtgcctgtcttgggctgggccatgggggaggggttcacctggtgaggaccacccatctcctccccgtcatcttgccctttctccctccgtggctgcagttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggtgccgtccccctcccctttactctcggccgggggagtgcagtgggcccacagggcctggggcggggtgcggagaccagggcctgaccggcacctgtgccacaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccgcctctgccgtccgcctgtgcctctgcccgcctgg

SEQ ID NO: 12959 - DNA, 645 bp, Homo sapiens; identical to SEQ ID NO: 12956

SEQ ID NO: 12960 - DNA, 1435 bp, Homo sapiens
gagtggctggagtctggctgcagagggaagacatcagcagggagggagccagggcctgtcacatctttcctctggccattgtcctggtctttgtaagcccaaaatctccccttccctgaagggaggccagcaccccaggagggcagcaggtgtgctgtgagggttggagtagtgtgagaggtcagggtacactaaaatggccatggacaccatgtgggggtgctctgggctgggccacaaaacagtgtccttcctgctgctcctcccctgcagcttcccccgaccttgtggtttatttggtttgataccaatcagcaaaccctgcagggtggaggctcccaggcctctcagtcccaccactctcatgtgccagtcagccctactgtaactgcccaatgagtacttcttgcccactgccaagatagagccagtttaccaagacaggggaattgcagtagagaaagagttgaatatacatagagccagctaaatgggagagtggagttttcttattacttaaatcagcctcccctaaaattcagaggtgagaatttttcaaggacagtttggtgggcagggcctagggaatggatgctgctgattggctagggatgcaatcataggggtgtagaaaaggtccttgtgcactgagtccacttttgggtgagagctaccaaggagctgctggtctgctggtcccggtagagccatctggtgtcaggaatgcaaaagtgtggccaggcacagtggcccacacttgtaatcctagcactttgggaggctgaggcaggaggaatgcttgagcccaggagctcgagaccagtctgggcaacatagtgagacctcttctctacaaaacattaaaaaaaaaatagccaggagtggtggcacgtccctgtggtctcaggtacttgggaggctgaggcaggaagactgcttgagcccaggaggtcaaggccacactgtgccatgattctgccactgcactccagcctgggtgacagaatgagaccctgtctgaaaatacatcttaaaagtccaatcctaggttctacaatagtgatgttatctgcaggagtaattggggaagttgaaaatcttgtaacctctgggacaagagtaattgtttatccctacatcttagcagaatccaggcccctctcatcctcttaacttggtggcctttcattagtattacgagggtggcttagtcgtgggaagggctgttatcatttaaattacaaactaaatttctcccaaagttagcttggcccactcccagaagtgatcaagggcagtttggaggttaaaggcaaaatggagtcagttaggtcagatctcttgcacttaaaatttttgcagaggtctcttcaccatggtctgcctgctgatggatgtggcccaagccaggcctgtggggagccgctgcatatcc

SEQ ID NO: 12961 - DNA, 1435 bp, Homo sapiens
gagtggctggagtctggctgcagagggaagacatcagcagggagggagccagggcctgtcacatctttcctctggccattgtcctggtctttgtaagcccagaatctccccttccctgaagggaggccagcaccccaggagggcagcaggtgtgctgtgagggttggagtagtgtgagaggtcagggtacactagaatggccatggacaccatgtgggggtgctctgggctgggccacagaacagtgtccttcctgctgctcctcccctgcagcttcccccgaccttgtggtttatttggtttgataccaatcagcagaccctgcagggtggaggctcccaggcctctcagtcccaccactctcatgtgccagtcagccctactgtaactgcccaatgagtacttcttgcccactgccaagatagagccagtttaccaagacaggggaattgcagtagagaaagagttgaatatacatagagccagctaaatgggagagtggagttttcttattacttaaatcagcctcccctaaaattcagaggtgagaatttttcaaggacagtttggtgggcagggcctagggaatggatgctgctgattggctagggatgcaatcataggggtgtagaaaaggtccttgtgcactgagtccacttttgggtgagagctaccaaggagctgctggtctgctggtcccggtagagccatctggtgtcaggaatgcaaaagtgtggccaggcacagtggcccacacttgtaatcctagcactttgggaggctgaggcaggaggaatgcttgagcccaggagctcgagaccagtctgggcaacatagtgagacctcttctctacaaaacattaaaaaaaaaatagccaggagtggtggcacgtccctgtggtctcaggtacttgggaggctgaggcaggaagactgcttgagcccaggaggtcaaggccacactgtgccatgattctgccactgcactccagcctgggtgacagaatgagaccctgtctgaaaatacatcttaaaagtccaatcctaggttctacaatagtgatgttatctgcaggagtaattggggaagttgaaaatcttgtaacctctgggacaagagtaattgtttatccctacatcttagcagaatccaggcccctctcatcctcttaacttggtggcctttcattagtattacgagggtggcttagtcgtgggaagggctgttatcatttaaattacaaactaaatttctcccaaagttagcttggcccactcccagaagtgatcaagggcagtttggaggttaaaggcaagatggagtcagttaggtcagatctcttgcacttaaaatttttgcagaggtctcttcaccatggtctgcctgctgatggatgtggcccaagccaggcctgtggggagccgctgcatatcc

SEQ ID NO: 12962 - DNA, 427 bp, Homo sapiens
ctgagaactgcttagagcagttattacttaaatcagcctcccctaaaattcagaggtgaggatttttcaagttcggtggggaggggcctatggaatgagcccctccctgtctcctattcaaagtcacccctctgctcattgagataaatgtatatctgattcccttctttggagaggctaatcagaaactcaaaagaatgcaaccatttgtctcttatttacctatgacctggaagcccctgccccactttgagttgtcccgcctttccagactgagccaatgtttatcattacatatgttgattgatgtctcatatgtcactaaaatgtagaaaaccaaactgtggtctgaccaccttgggcacatgtcaggacatcctgaggctgtgtcatgggcgtgtgtcctcaaccttggcaaaataaactt

SEQ ID NO: 12963 - DNA, 5099 bp, Homo sapiens
ttttttttttttttgagatggagtctcgctctgtcgcccaggttggagtgcaatggcacagtctcagctcactgcaacctccgccttccgggttcaagcagttctccctgcctcagcctcccaagtagctgggattagaggcgcctgccaccacacccagctaattttttttttttgtatttctttagtagaaacagggtttcaccatgctggccaggctggtctcaaacttctgacctcaggtgatccacccatcttggcctcccaaagtgctgggattacaggggtgagccaccacacccggcctccaatcacatttttatgaaactatgctatatgtccatccatctgtgctctatgacagtaagtgtagagagggaaacccagcaaagtacataccaaatgtcaacagtgttcatctcaccagtgggaatgagctatagatttcaggaatccgaactttttttctctcttttttttttttttttgagacagactctcgctgtgttgccaggctggagtgcaatggcgcgatcttggctcactgcaagctccgcctcccaggttcatgccattctcctgcctcagcctcccgagtagctgggactacaggcacccgccatcacacccggctagttttttttttattttttatttttagtggagatgggatttcaccttgttagccaggatggtcttgatctcctgacctcgtgatccacccaccttggcctcccaaagagctgggattacaggcgtgagccaccacgcctggccgaatgtgaacatttttataagaagctagattttgtaggtagaaaacccaataagatacttttcacaagaaaggaggcaggattgaggagggaggtgggcagcagaggctgcgtgcgtgggtcttgcagagaggggccagagcagccggttctctgcacccctctgtctcaggctctgaagcggaaggattactcttgggcatggagggtctttctctctctgaaccagtcccaagggccctcgggggacacgccactccctgtgcacagggcagggttctgtgtgccagccccacgcaggtgctgcatgctggggactcagaggggtccctgagcaggtactggggacacctctgcactcagagaggcggcggctcaagagcagggcatcagaactcaccatgatgaagaagtaccagggctgaggcacgccgaactgccctgggaagacggcctccatgtaccaggtcaccaggccatagagcacagagtccagcagcagcatccccagcacctgcccgaagcagaagtcgtcgtccacgttgacgggactcaggaggtctcgccactggatgcccatgcctggaagacacatcaggaaagtggcccgaaagccagcaggctggggggcccagggacccgaagcccctgatggcacacgtgtgcacatttgaccttgcatggccactgcttggttggcatgccttttcccttcccggttttataacaagttggacagctttcttcaagcctggaagataaactcaggttacaaaataattaagtcacagaccagcaacagctcattcactgactagacaggcttgcatttaatctgtgacatatatgcacatatgtacacacgtacatatgcacccacatctatgatttcggtaaggccaacgtgggtcaatgtgcatttagcataagtctttttttttttttttttttttttgagatggagtcttgctctgtcgcccaggcaggagtgcagtgctgcgatctcggctcactgcaacctctgcctcccaggttcaagcaattctcctgtctcagccttccaagtagttgggattacaggcgcatgctgccatgcctgggctaaattttttttttttttttttgagatggagtcttgctctgtctcccaggctggagtgcagtggcacgatctcggctcactgcaagctccacctcccgggttcacgccattctcctgcctcagcctcctgagtagctgggactacaggcgcccgccaccgtgcctggctaattttttgtatttttagtagagacggggtttcactgtgttagccagggtggtctcgatctcctgaccttgtgattcgcctgcctcggcctcccaaagcgctgggattacaggcgtgagccactgcaaccagccctaatttttttgtattttagtagagatggggtttcaccgtgttgcccagcctggtctcgaactcctgagctcgggcaacctacccgccttggcctcccaaagtgctaggattacaggtgtgagccactgcacccggccagtataagtctttatttgtttattattttttatttttttgagatagagtcttgctctgtcacccaggctggagtgcagtggtgcaatcttggcccactgcaacctctgcctctggggtttgaatgattcttctgcctcagccttcggagtagctgggattacgggagcacgtcaccacacctggctaatttttgtattttttttagacagagtctcactctgttgccaggctggagtgcaggggcacaatcttggctcgctgcagcctccacctcccaggttcaagcggttctcctgcctcagcctcccgagtagctgggactacaggtgtgcaccaccatgcccagctgatttttgtatttttagtagagacggagtttcaccatgttggccaggatggtctcgatctcttgaccccatgacccgcccacctcagcctcccaaagtgctgagattacaggcgtgagccaccgcgccccgccaatttttgtatttttagtagagacagggtttcgccatgttggccaggtgggtcttgaactcctgacctcgagtaatccacccgtcctcccaaagtgctgggattacaggtgtgagccaccccatccagcctagtataactatttttttacattttaattttgtagtgatgggggtcttgctatgttgcccaggctggtctcaaactccagcctcaagccttcctcctgcctcggccataagtcttttttaatcacagaaatatttcaaacacgtgtaaagctctctttaatggagctcgtgtttctcatcatctctctggtttgccaacattgcagtcctgacagtgctggggatctgtgtgtccaaacaccctctgtttggccgaggaccctgatggaaataatgctctccagccttggtgaatttgcactttcaaacaaccagagatttgtctgttttaataacattcactctagctgggcgtggtggctcacatctgtaatcccagcactttgggaggctgacacaggaggattgcttgaggccaggagtttgagaccagcctaggcaacacagacaaattagccaggtgtggtggcacgtgcctgtagtccagctactcaggaggctgaggtgggaggatcacttgagcctgggaggtcgaggctacagtgagctattatcatgctactgcactccagcctgggcaatggagtaagaccctatctccaaaaaaaaattgttaaaaagaaagcaaaagaacaaagtttacattttatcaacacacgagtaaacatggaaacacagatatgtaaaagctaaagtgtcagaagacactgccgactgtagagaaccgttctaatgaaagacaaagcaacgctggacactcccacctccttccacagacccagaccttggcaagctgcagctaggaactgcatggtgccacggcttgactgggccccccaaattcatgtgttggagacttgacccccaatgcagcaatgttgggaggaggcctaactggaggggctcagaccaggtttggtgcccacagcaggctttgcagaatgagagcccacaggccaaaggctgaccaaggaagtgttttactcaatttaatttcataaaaattaagaaaaaaagtgggcggctcacgcctgtaatcccagcactttgggaggccgaggcgggcggatcacaaggtcagaagatcgagaccatcctagctaacacagtgaaaccccgtctctactaaaaatacaaaaaattagctgggcacggtggcgggcgcctgtagtcccagctacttgggaggctgaggcaggaaaatggcatgaacccgggaggcggagcttgcagtgagccgagattgcgccactgccctccagcctgggtgaaagagtgagagactccgtctcaaaaaaaaaaaaaaaaaaaaagaaaagaaaagaaaaaaagtgagtcgtgatggtgccattgcactccaggctgggtgacacagcgagatcctgtctcaaaaaacaaaaaagaaaagaaaaaaaatgctgtcgtttatcacttgtttctctcttaggcgtctctgctgccatcaccaatcaatacaggaggcactgggaagatgctaattctaccctttaccaagagcagtggttgatgaaaagtcctcgaaacccagccagcctcagtggctcactcctgtaatcctagcactttcggaggccgagggcagatcactttaggtcaggagttcaagaccagcctggccaacatggcaaaaccccctctctactaaaaatacaaaaaaattagatgggcatggtggtgcatgcctgtgatcccaggtactcgggaggctgaggtgggaggatcacttgaacccagaggcagaggttgagatgagccaagatcgcaccactgcactcaaacctgggaaacagaacgagactcttgtctcaaaaaaaaagaaaaaaagtcctcaaaaccctagactttgagatctctgatgtaataattttattttatttttttgagacggagtcttgtcacccaggctggagtgcagtggtgcgatctcagctcactgcaagctccgcctcctgggttcacgccattctcctgcctcagcctctcgagtagctgggactacaggcgcctgccaccacgcccggctaattttttgtgtttttagtagagacagggtttcaccttgttagccaggatggtctcgatctcctgacctcgtgatccaccggcctcagcctcccaaagtgctgggattataggcgtgagccacc

SEQ ID NO: 12964 - DNA, 6112 bp, Homo sapiens
tgcatcttggctgggcacggtggctcgagcctgtaatcccagcactttgggaggccgaggcgggcggatcatgaggtcaggagatcgagaccatcctggctaacacggtgaaaccccgtctctactaaaaatacaaaaaaattagccgggcgtggtggtgggcgcctatagtcccagctactcgggaggctgaggcaggagaatggcgtgaacccgggaggcggagcttgcagtgagccgagatggcaccactgtactccagcctgggcgacagagcgagactccgtctcaaaaaaaaaaaaaaaatcagaatgcatcttaaactataaaatgccatagtgtaagtgtggcatttttctttcttagtgatagacaaagtaaccattacctctaacggtcagtgtcatcttacagttgatggattacagtagtgaacacttgataactacttgtggaagcaaagaatgaaaacagaaatggcctcggctggaggtggtggctcacgcctgtcatcccagcactttgggaggccgaggcgggtggatcacctgaggtcaggagttcaagaccagcctggccaacatggcgaaaccccgtctctaataaaaatacaaaaaaaattaggtgcgtgtagtggtgggtgcctgtaatcccagctactcaggaggctgaggcaggagaatcacttgaacctgggaggtgaagggtgcagtgagctgagatcgcgccactggactccagcctgggcaacagagctagactccgaatcaaagaaaaaaaaaaaaaaagaaatgaccttaactagccatcggtagggaatcagttaagtatatgttgatgggcccacagaatggaacactgtgtgtcactataaatgaaggtggtttgttgggagcaagccccccaaagtctggccataaactggccccaaaactggccataaataaaatctctgcagcaatgtaacacgtccataatggccataacacccaagctggaaggttgtgggcaaggaacacctggcccgcccaggcggaaaaccgcttaaaggcattcttaagccgcaaacaaaagcctgagagatctgtgtcttaagggcgtgttcctgctgcaagtaattcggcccatccatccatttcccttaagggatacttttagttaatggaatatctatagaaacaatgctaatgactggtttgctgttaataaatatgtgggtaaatctctgttcggggctctcagctctgaaggctgtgagacccctgatttcccacttcgcacctctatatttctgcgtgtgtgtctttaattcctctagtgccgctgggttaaggtctccccgaccgagctggtctcggcagtgattcttaaaaaggtaatacttaggtagaaatatatttataaatataacaacattcatcaatatgtttagataatagtttaaaactatatttataaatagacaaacatatatatgtatttaagatatctgagttgtactgttaggttaagaaaagcaacttgtaagcattttttacaatatgattcttttttttttttttgagacagggtctcattttttcaccaaagttggagtgtggtggtgtgaacatggctcactgcagcctcctgggctcaagtgattcttctgcctcagcctctcaagtagctgggaccacaggcatgtgcgcctggctaattttttaaattttttatttattttgtagagatggggttgcactatgttgcccaggctggtctctaactcctggcctcaagtcatccttccacctcagcctcccaaagtgctgggattacagggatgagcgactatgtccaccccgatcccattttttttttttttgagatggagtctcgctctgtcgcccaggttggagtgcaatggcacagtctcagctcactgcaacctccgccttccgggttcaagcagttctccctgcctcagcctcccaagtagctgggattagaggcgcctgccaccacacccagctaattttttttttttgtatttctttagtagaaacagggtttcaccatgctggccaggctggtctcaaacttctgacctcaggtgatccacccatcttggcctcccaaagtgctgggattacaggggtgagccaccacacccggcctccaatcacatttttatgaaactatgctatatgtccatccatctgtgctctatgacagtaagtgtagagagggaaacccagcaaagtacataccaaatgtcaacagtgttcatctcaccagtgggaatgagctatagatttcaggaatccgaactttttttctctcttttttttttttttttgagacagactctcgctgtgttgccaggctggagtgcaatggcgcgatcttggctcactgcaagctccgcctcccaggttcatgccattctcctgcctcagcctcccgagtagctgggactacaggcacccgccatcacacccggctagttttttttttattttttatttttagtggagatgggatttcaccttgttagccaggatggtcttgatctcctgacctcgtgatccacccaccttggcctcccaaagagctgggattacaggcgtgcagccacgcctggccgaatgtgaacatttttataagaagctagattttgtaggtagaaaacccaataagatacttttcacaagaaaggaggcaggattgaggagggaggtgggcagcagaggctgcgtgcgtgggtcttgcagagaggggccagagcagccggttctctgcacccctctgtctcaggctctgaagcggaaggattactcttgggcatggagggtctttctctctctgaaccagtcccaagggccctcgggggacacgccactccctgtgcacagggcagggttctgtgtgccagccccacgcaggtgctgcatgctggggactcagaggggtccctgagcaggtactggggacacctctgcactcagagaggcggcggctcaagagcagggcatcagaactcaccatgatgaagaagtaccagggctgaggcacgccgaactgccctgggaagacggcctccatgtaccaggtcaccaggccatagagcacagagtccagcagcagcatccccagcacctgcccgaagcagaagtcgtcgtccacgttgacgggactcaggaggtctcgccactggatgcccatgcctggaagacacatcaggaaagtggcccgaaagccagcaggctggggggcccagggacccgaagcccctgatggcacacgtgtgcacatttgaccttgcatggccactgcttggttggcatgccttttcccttcccggttttataacaagttggacagctttcttcaagcctggaagataaactcaggttacaaaataattaagtcacagaccagcaacagctcattcactgactagacaggcttgcatttaatctgtgacatatatgcacatatgtacacacgtacatatgcacccacatctatgatttcggtaaggccaacgtgggtcaatgtgcatttagcataagtcttttttttttttttttttttttttgagatggagtcttgctctgtcgcccaggcaggagtgcagtgctgcgatctcggctcactgcaacctctgcctcccaggttcaagcaattctcctgtctcagccttccaagtagttgggattacaggcgcatgtgccatgcctgggctaaattttttttttttttttttgagatggagtcttgctctgtctcccaggctggagtgcagtggcaactcctcggctcactgcaagctccacctcccgggttcacgccattctcctgcctcagcctcctgagtagctgggactacaggcgcccgccaccgtgcctggctaattttttgtatttttagtagagacggggtttcactgtgttagccagggtggtctcgatctcctgaccttgtgattcgcctgcctcggcctcccaaagcgctgggattacaggcgtgagccactgcaaccagccctaatttttttgtattttagtagagatggggtttcaccgtgttgcccagcctggtctcgaactcctgagctcgggcaacctacccgccttggcctcccaaagtgctaggattacaggtgtgagccactgcacccggccagtataagtctttatttgtttattattttttatttttttgagatagagtcttgctctgtcacccaggctggagtgcagtggtgcaatcttggcccactgcaacctctgcctctggggtttgaatgattcttctgcctcagccttcggagtagctgggattacgggagcacgtcaccacacctggctaatttttgtattttttttagacagagtctcactctgttgccaggctggagtgcaggggcacaatcttggctcgctgcagcctccacctcccaggttcaagcggttctcctgcctcagcctcccgagtagctgggactacaggtgtgcgccaccatgcccagctgatttttgtatttttagtagagacggagtttcaccatgttggccaggatggtctcgatctcttgaccccatgacccgcccacctcagcctcccaaagtgctgagattacaggcgtgagccaccgcgccccgccaatttttgtatttttagtagagacagggtttcgccatgttggccaggtgggtcttgaactcctgacctcgagtaatccacccgtcctcccaaagtgctgggattacaggtgtgagccaccccatccagcctagtataactatttttttacattttaattttgtagtgatgggggtcttgctatgttgcccaggctggtctcaaactccagcctcaagccttcctcctgcctcggccataagtcttttttaatcacagaaatatttcaaacacgtgtaaagctctctttaatggagctcgtgtttctcatcatctctctggtttgccaacattgcagtcctgacagtgctggggatctgtgtgtccaaacaccctctgtttggccgaggaccctgatggaaataatgctctccagccttggtgaatttgcactttcaaacaaccagagatttgtctgttttaataacattcactctagctgggcgtggtggctcacatctgtaatcccagcactttgggaggctgacacaggaggattgcttgaggccaggagtttgagaccagcctaggcaacacagacaaattagccaggtgtggtggcacgtgcctgtagtccagctactcaggaggctgaggtgggaggatcacttgagcctgggaggtcgaggctacagtgagctattatcatgctactgcactccagcctgggcaatggagtaagaccctatctccaaaaaaaaattgttaaaaagaaagcaaaagaacaaagtttacattttatcaacacacgagtaaacatggaaacacagatatgtaaaagctaaagtgtcagaagacactgccgactgtagagaaccgttctaatgaaagacaaagcaacgctggacactcccacctccttccacagacccagaccttggcaagctgcagctaggaactgcatggtgccatggcttgactgggccccccaaattcatgtgttggagacttgacccccaatgcagcaatgttgggaggaggcctaactggaggggctcagaccaggtttggtgcccacagcaggctttgcagaatgagagcccacaggcaaaggccgaccaaggaagtgttttactcaatttaatttcataaaaattaagaaaaaaagtgggcggctcacgcctgtaatcccagcactttgggaggccgaggcgggcggatcacaaggtcagaagatcgagaccatcctggctaacacagtgaaaccccgtctctactaaaaatacaaaaaattagctgggcacggtggcgggcgcctgtagtcccagctacttgggaggctgaggcaggaaaatggcatgaacccgggaggcggagcttgcagtgagccgagattgcgccactgccctccagcctgggtgaaagagtgagagactccgtctcaaaaaaaaaaaaaaaaaaaaaaagaaaagaaaagaaaaaaag

SEQ ID NO: 12965 - DNA, 300 bp, Homo sapiens
cccacttcttttttttttgagaaggagtcttgctctgtcgcccaggctggagtgcagtggcacgatctcggctcactgcaagctccgcctcctgggttcacgccattctcctacctcagcctcctgagtagctgggactacaggtgcccgccaccacgcccggctaattttttgtattttttagtagagatagggtttcaccgtgttagccaggatggtctcgatctcctgacctcgtgatccaccggccttggccttccaaagtgctgggattacaggcgtgagccaccgtgcccagcc

SEQ ID NO: 12966 - DNA, 298 bp, Homo sapiens
ggctgggcacggtggctcgagcctgtaatcccagcactttgggaggccgaggcgggtgaatcacgaggtcaggagatcgagaccatcctggctaacacggtgaaaccccgtctctactaaaaatacaaaaaaattagccgggcatggtggtgggcgcctatagtcccagctactcgggaggctgaggcaggagaatggcgtgaacccgggaggcggagcttgcagtgagccaagatggcgacactgcactccagcctgggcgacagagcgagactccatctcaaaaaaaaaaaaaaaa

SEQ ID NO: 12967 - DNA, 198 bp, Homo sapiens
cttttcccaccccgttggtggcctgacaagttcatctctaaggttggtttcactattgctaatgctagagacttgtcacacacatttccaacaatgaaactggaaaactatttatttgaaagcctttctttaattatagttgtttggtctctaagtaatagttctgaggtttgcagaaaagtaaaacaaatagtagga

SEQ ID NO: 12968 - DNA, 198 bp, Homo sapiens; identical to SEQ ID NO: 12967

SEQ ID NO: 12969 - DNA, 198 bp, Homo sapiens; identical to SEQ ID NO: 12967

SEQ ID NO: 12970 - DNA, 1962 bp, Homo sapiens
gcaattgcctcagttgcctaggctgtgggagtttgtgatggcaatgctgtagatgagggtactgagctgatttctggccaagacatgtacaggctaaaatggctgccaggctgtctatctggttttccagggaggcagtagttgctgctgtggtggctgtcgtgctgggctcaggcctttgccgcggtggcctgctgggcagctctgtggctatgtagggaaatggggctactgcctggttggctgttgctttgggctaggctcaaatgcttttgtgcagtggggctgggcagtttggcagcagtctatggtagggggccagggctaccacaggaccagttggactgtgtgctgtgggactgtgggactctgggactctatcgtggccagttttaggggacaggaccactgaattaccagctgtcaggcagggcgtgggcaggtggttctgtgatgggttgtgagggagtggggctgccgcaggattggctttttggctgagtactggcgtgtgcatacttggcagcccagatggttgtatggaacaggggtgttgggtaaagcgctgccagctgtctatttgatggcttccttgctgtgcatgtctgcctgttttctggatggttggtagcgctatgtggggtctgatgctgagatcatcgtcactctgtttgacctagactctatgtggatggggttatggtgctgcaggccatcatgtgatcatggtagaatgatggcgggttctcagggatgaagagagtcagttgctactggtccccagggcaggatgcacactagtagtgagtctagcttcaacttggtgccatgctacagcagcttaggacaaggtgggctcccactctgaggcagtacagctgaatgatctcttggctactctccagactggatttgtggccactgaggacttaaggactctcctttatcaagaattgctggtgcctgtggcagcagtggggaccactgataggtatctctagcttactttttccctgtaagaatttcctctgattttaagctgattttggcaagggagacagtgtggcaggtaggaaacctcactcccttccctgtggtgctatcctgaggcttccatgctccacagggattttgccctttctctggtgctctgcagcatatatctacagtcattttagttgaaatatagttatttgttattttggtccctttttgttgtgggtgatatgtgccaggtaactctggtgagccatttttttttaaacaaatcttcatacagattgagtatcccctatccaaaatgcttgagaccagaagtgttttggattttgtagtgtagagtatagcttttggattttggaatagtttatttgtattatacttacttgttgggcatcccaaatctgaaatatgctccaaaatccaaaatgtgaagtgctccagtgaacatttcctttgagcatcatgttggtactcaaaaagttttggattttggagcattttggatttcagatttttggaattgggatgttgaacctgtataatctttaaatcacctgttcagcaaatcgacaaacatcgaggacagtttctgtcttcaacgaagttgatagtcaggtagccagggatagctaatcagtgaataataatacctggtactggtaggaaagagcaccaaccacaaccacagaaggcttcttggaggagctgatctctgaactgagttttgaaggatgagtaactaggtagcgatgcagagaaagagaaaatatgagcagggatataaaagcagtacattatcatgcatagcaatatactaagctgcaatatcatactaaactacaagcagtttagtgctttctagttgcgggggtaatgttcaatataggggatctgtaacgaggtaagttggagaggaaaacagaagccaggttctgcagcaacttagctttgtagcctcga

SEQ ID NO: 12971 - DNA, 1962 bp, Homo sapiens
gcaattgcctcagttgcctaggctgtgggagtttgtgatggcaatgctgtagatgagggtactgagctgatttctggccaagacatgtacaggctaaaatggctgccaggctgtctatctggttttccagggaggcagtagttgctgctgtggtggctgtcgtgctgggctcaggcctttgccgcggtggcctgctgggcagctctgtggctatgtagggaaatggggctactgcctggttggctgttgctttgggctaggctcaaatgcttttgtgcagtggggctgggcagtttggcagcagtctatggtagggggccagggctaccacaggaccagttggactgtgtgctgtgggactgtgggactctgggactctatcgtggccagttttaggggacaggaccactgaattaccagctgtcaggcagggcgtgggcaggtggttctgtgatgggttgtgagggagtggggctgccgcaggattggctttttggctgagtactggcgtgtgcatacttggcagcccagatggttgtatggaacaggggtgttgggtaaagcgctgccagctgtctatttgatggcttccttgctgtgcatgtctgcctgttttctggatggttggtagcgctatgtggggtctgatgctgagatcatcgtcactctgtttgacctagactctatgtggatggggttatggtgctgcaggccatcatgtgatcatggtagaatgatggcgggttctcaaggatgaagagagtcagttgctactggtccccagggcaggatgcacactagtagtgagtctagcttcaacttggtgccatgctacagcagcttaggacaaggtgggctcccactctgaggcagtacagctgaatgatctcttggctactctccagactggatttgtggccactgaggacttaaggactctcctttatcaagaattgctggtgcctgtggcagcagtggggaccactgataggtatctctagcttactttttccctgtaagaatttcctctgattttaagctgattttggcaagggagacagtgtggcaggtaggaaacctcactcccttccctgtggtgctatcctgaggcttccatgctccacagggattttgccctttctctggtgctctgcagcatatatctacagtcattttagttgaaatatagttatttgttattttggtccctttttgttgtgggtgatatgtgccaggtaactctggtgagccatttttttttaaacaaatcttcatacagattgagtatcccctatccaaaatgcttgagaccagaagtgttttggattttgttttgttttgttttgcttttggattttggaatagtttatttgtattatacttacttgttgggcatcccaaatctgaaatatgctccaaaatccaaaatgtgaagtgctccagtgaacatttcctttgagcatcatgttggtactcaaaaagttttggattttggagcattttggatttcagatttttggaattgggatgttgaacctgtataatctttaaatcacctgttcagcaaatcgacaaacatcgaggacagtttctgtcttcaacgaagttgatagtcaggtagccagggatagctaatcagtgaataataatacctggtactggtaggaaagagcaccaaccacaaccacagaaggcttcttggaggagctgatctctgaactgagttttgaaggatgagtaactaggtagcgatgcagagaaagagaaaatatgagcagggatataaaagcagtacattatcatgcatagcaatatactaagctgcaatatcatactaaactacaagcagtttagtgctttctagttgcgggggtaatgttcaatataggggatctgtaacgaggtaagttggagaggaaaacagaagccaggttctgcagcaacttagctttgtagcctcga

SEQ ID NO: 12972 - DNA, 1962 bp, Homo sapiens; identical to SEQ ID NO: 12971

SEQ ID NO: 12973 - DNA, 1666 bp, Homo sapiens
cactgaaaacttttttttagtttcacaaagtggaaatggttaaggttttttttttttttttttttttgggtcaaaagaatcccttatttttgcaaatgctaaaataatgcactaatcattgagcagttttaataacaatttcttaaaaccccttttaaacatatattcactgaattcaagagaagtataacacatagttgctccttccaagggggcttactgtatacttaggatgaacataattaagtaactaaagatgcataaataactataagccttccatgtggtaccaaagagaagtggaatgggagttagggaaagcagaagctactgagggaagtggagctcacagtgatcttcaaggaagttaaactggagttttaaagatgggagaaacacttgtgtcagtgtttctgaaacctccagcactgacttggctgcttagagctatctgtttaatggtccagacatgggctgtgggacagagatcttggcctcaaagcctggctctcccatgttacctaaacaggtaattttagtaccccatatttcagtttcctcagttctaccagagaatgaagtgaataatagtgcatactttatagcgctgttgcgaggatcagatgaattaatactgataaagtgctaccagcacttattaggtactcgatacatgttagttattattttcttgcaccactaaaatagcatttatccttgggaggtgagcttcagcccaggagttcgagaccagtctggccaacatggtgaaatcctgtttctataaaaaatagaaaaattagccgggcatggtggcacgcctatagtttcagctgcttagtagactgaggtgggaagatgactggagcctgggaggttgaggctgcagtgaaagccatgattgtgccactgtactccagcctgggtgacagagtgagaccctgtctcaaaaacaaaaacaacaaaaaagagagtttacttaatagtcctcattttaaaattaagggtctttgctcaaggaaatgtatttaaaaggtattttgagatcgttattctaaatgcataatgaatctcatttgcctcaatggaagataaccataaaaacaaatacaaggaaaacagtgctattaaattctagctatatactgaggcctgccaaggctctgagctgaagcctgtttcctcattgtaaaaaaaaaacaaaaaacagaattcagcaagtattagaaggattacagacatactggcaccaatttaaatttcctccttcgaaggactgaaagaattgaaaagggaatagcttgttcagtatgtggtttactgctatttaatgccaacgtgcatcttccatctcgaatcatctcagcatgcttctgtactttgacagagccatcagaagacaatgtgaaggagcagtgttcatttaccattgactggtcttgtgttcaaaggtgtgtcatatatactgactgtatattgtcagtggcatacattatattctattttccatgaattacaacttccattcagaagcacaaaaaaaattattctctttctctaatttttaaacctgagagcagccataaaaaagaacaggttcatgtctttcgtgggaacgtggatggagctggaggctgttgttatccttagcaaactaacacaggaa

SEQ ID NO: 12974 - DNA, 1255 bp, Homo sapiens
ggctttcaaattttttaaaaagtgttttcaaaatttaaaaccatacaagtgatatttatttaagacatcagaagtagctctgtcttgcccttacttttatatataaggaataagcctgggatgatatttgcaagagatagagttaagaataaacacatgaataataaataaaaaaacagaatttgatatatttctcataccactttccaaatggtgttaaaaattcagaatctggtgtatttattaaccctttgtaatttatttaaaaataaattttgtgcctaaaaatctaatatgaattactttaggaacattctaaaattacttcacaatttacacactgcttcaaaacatattctaactcttaatattttattgaaaatgttatatatttaatcagaagtaggcatcacatattttagacacttctattaggaaatacaattcatactaataacatctacaaaatacaaaattctgctagttcatattttccatttcatttattcagcaaatatttattaagtgactagtatgcgtcagccaatgttctagccactgaatatacagcagtgaataaaaaattctgcctcttggaaattacactcatgtcctttaggctcttaatgaaatgtaacatgaaatgtgattttccatgtataagaaaattatttttattttactatttgcattcgacgaagtattacaaaaataatatagtctcattccttagtagtttttatattcatcttttagagtgcatgaaaagacaatcaaaactataaacagagacaaaacattttcctttgtcttttagacttccttctgttctccttattttcactgttttatagcaaagccctgcgggcagggaaccatccatgacttacttgtctttgtgttccaagcatccagccctaaacctggcacattcttggtgctcaacaagctgtactgaataaatgaataatttcaatatacaggtatttataataaaatcacaccaggagaaaccaaaactattgcatggacgtttaacaaaagatatccaaagtggtctgaatggcaactatttgtgttagcacattcttacacctgtctgggatgcctccaagaacactctaaagccttgaaactgtttgatctcttccagagggccttcagaggataatcagacaccataattgttaccttccaggatggaatgtgaatctctttgctttcctctaacaaatcctcagggcgtgggagtggg

SEQ ID NO: 12975 - DNA, 1767 bp, Homo sapiens
agctagatgggtgatatggcaactcaggattctacctgaatcagcatagtaaagtatttggtgtgctggggtagtttttgaacccattctgcttttctttccttttcctgacacttacctcttgcaatccaagcgaagagagaagactggctgctgtttctctgccccttttccctgcagatctgtcccaactactccatcccaacactcccatctgtcccacgtcaagaggctggtttagaggagtttatgtgaggatgatctcttctttgccccctctgccttttctttccattttttttaggggagccctgtacttggtactttttctttggcttttcacttctcccaaaatagttatatctactttagttacttgtcataagtacagacacatcttctgtaatctccatcctctttccccacttccttccaattcttgcccatttgcttcaagaagggctctcttccttaacatgctctcttcctatttccttgctcctttcatgaaaaagccaacatcttggctgacaagtcacacacctttgtcaaggaaacaaacaaaatcctccatccaccctcatgatggagggtactccagctgctgggtcctttggctgcagtgtagacctagaggaagagagaagcccagagactgagctgggagagtgggcacagacttgacattcatctcagcaaacagggtggagaagggtaaagccaaagctgggactgtgaggaacagggtggccaagaatgcagtgtgcagtggaagacggtttgaatacattccagagatggggagcagagcactttaacctactctccaccctggcttgtgttgttaacagacaattattaatggccaggaatgagtggaccgtagccagtgtggctgacacctaaaacagtgttacagatcagttaactatacaagtcctgcacagtggatgctgggagaaaagggaaggagtgggaagagaagatagagttgcggagttttaaccactgttgccaaagataggggatagaagagaaagaaaaacaaggctctaatccttaaaaaatttcccgaaattctcttaagaaagtcttttcaaaagtttccatttacatttcttctgtcttaaacacaaattttaaccacaattactattcagtcaattaaatgtttggttgtacttactgcctaatatacttttctgctctttctataagcaatgtgtagtataaatttgcttatctgtagaagtcaattggattagatgatttctaggatcccacctaatccccccaaagtctgtaacacttgtattttcacttgtattttataagcactggtagctcatcctgggaacctaaccatctcgggttttttttttgttgttgttgttgttttattcttacaacagagattgcattataagttcaaaataaccaacttataaagaaataagcaattggaaactaaactagttgtatgatgaatttctgcaaggtatttgaatatattttgaatatacaaaagaggatgaactaggtaaactttataatcctttataccttaaaattctatagtatcttgtaataaaatacaatggataaaggtttgcttatttttcagaagagcagctacttttaaagtcgtggctcttgaaattatgagttattatatattcctattaacttgtctttaagaaacttgtttataatctctatatatttaaaaatactcaaatttccatgcatttaaaagtttatttagtc

SEQ ID NO: 12976 - DNA, 4992 bp, Homo sapiens
aggcctgcccgccctgatggtcatcggcactgggagtgccaacagctacggcctctacaccatccgtgatagggagaaccgcacctctctggagctgtgagtggcggctgtgggagcaggggtgatgccagctccccggctacacatattggggctggagagaggtggggagaggagggatttctaggaaaatctagaccaaatatgtcaagaccagaagaatcctcagatccagctagctcatggcacagagaagtaaactgaagcctagagagagagaggggaagtgaaatgagagagggggcctgagaaaggagagggagaactggaccaggaggcaggatgccttacttgagcctgggccaacacgagcccacatggcaccttgaggcaaagtaaagaaggtcaccccgtccgcatgcggggtgcgcagcctggagagtggagggtgtgttggatttcagcccccacctgctgcccagccaggtgtccttgttcaggccaccacctgcccagtgattcacagtagccctgggtctagtctgggctctgccctgcctgctatgtgtgtgatcttggcaggcccgatctctcccagggcctcagtctcctcatctgcaccatgggggaactgatcaacatgctctttgaggccctttgcccctgcagtgcagagggcagtggagctgagttcagtttctagactcacaccttgggatccatggggcacccaccactgggcccatggctctgtgctaagaggagctggtgaggccttggacctgtccccaggcctcaaaagcaggggccccaggagctggaggggtcacaaaggtgcaggcagtgggccaggtggggactgcagcggactggcagtcacaagcccatctaattagcggtcagttactatccttcaggagggcatccacagagctgccaggtgtatgattttataggagaagcagaaatctaggtgtttataccaaagcttctgattttaaaggcggccactaattccgtttttttcacaatgtaatatggggcaaatgaaacatgtctttgaggtcactttggcattaaagagacaccagactggagccaggtgacggcccctcccacagcgggagagccagggattgatgggtggaaatgggagaggcaccttcacagacagaaaagctcagccaggggacttcctgggtttgctggccagaggtaccactcccagtcccaccacagctgccccctcctccagatgctggttccgtgaagggacaaccatgtacgccctctatatcaccgtccacggctacttcctcatcaccttcctctttggcatggtggtcctggccctggtggtctggaagatcttcaccctgtcccgtgctacagcggtcaaggagcgggggaagaaccggaagaaggtgctcaccctgctgggcctctcgagcctggtgggtgtgacatgggggttggccatcttcaccccgttgggcctctccaccgtctacatctttgcacttttcaactccttgcaaggtgaggcccctgcaccagggaggtgatgggctgtgttgtctgtcccaggaggtattgggaggtggggaagagggtggtttgcaagacacaggactctgttcaggctagctgaagtcaaggatgttgatttcaaatactcagagcaaggatccagggcagcaaagtttggctgctgtattagtccgtttgtgttactagaatacaaaggaatactcgagactgggtaatttataaagaaaatggggttaattggctcatggttctgcaggctttagacaaagcacaacaccagtatctgctcctggtgaggcctcaggaagcttccaatcatggtggaagataaaggggagccaggcgtatcacatggcgagagtgggagcaagggagtggggaggcaccatgccgttttaaacagcgagatctcgcatgaactccaagtgagcactcactcatcaccaaggggatagtgctaagccatgcatgaggatccgctccaaggatccaatctcctcccctcaggccccacctccaacattgggaatcacatttggacatgagatttggaagcaacaaacatcccagacatatcagctgccttcatgggagctgctaccagaatcagaaaaagccacccaaaccaaagcagatacgttctctatctttttcctggagctatggagtctctcacctagtgtctgtggaaactccttcattctctctccacttaccctttactacccatggccccaaattgttacccaacatggctgccgtaaccctacctgaccttgcaagttgggtgtccatcgtccatctctggtccaatcagctgcgaccagaagggcagaatcatgtgatatgatgtccacatgacatggatgggatctccagggatctatggaggtaggaaggaaatgcttgctgtatttgttactggcccccgcagggcccttcctctgagatcccagcaaaggggtaagagcagtccatgtgctatggtttatatgtgttctctttgctccttacatccacagcccagagaggcatcacagtctgactgtgagagaaacagccaagacaggagtgacgagactcaacctgttcagggaagtcactagaaacccaggcgtcctagatgcagcgggtataagcccccaagaccaggactggctcccagcgccccatgagagatgtgtggcttagtggctagggccaggcagccctgggtccaaatcctagccccatccctgacccagcaagtcactcagctccttccgtcctcattcatcgcgaaattgggataatcccgtacttatctcaccagcttttttttttttttaattgagatggagtcttgctctgtcacccaggctggagtgcagtggcacgatctcagctcactgcgacctccacctcctgggttcaagtaattcttctggtttcagcctcctgagtagctggaactacaggcacatgccaccatgcccagctaatttttgaatttttagtagaaatggggtttcaccatactggtcaggctggtctcaaactcctgacctcagatgatctacctgcctcagcctccgaaagtgctgggattacaggcgtgagccactgtgcctggcctgccagatttcacaatgaacaatgacaatgcatatgtgggaactactaggtcttcaatatgtgggaactatattaataatcatagaaattatgactgtaaggccatctgaggctgtctccaggtggagaatcatgagtccatgcctggagaatcccaggggttgatggttggggagaaatgaactttgaaactatagctgacatcgttattctttcagaggttaccttaatatgtaagcctgcacacttcactctactaagtttccactgggtctgagttattctgtatttctctcttcctctccaatacaacagagcccttggtatacttgaattgcccattgaactcttctcaatatttgtcttgcatatagaggtttagttacagatttccttgaaacatagagtttttctaagtcatgttctgtacttactataatttctttcaccccacactttcccttttcctcttgctggagtgcctcccataataatcctttatagagggagtgatggttgttttgtatgtctgaaaattcctctattttgctctttcttttctgtaataggcataggtagatattttatttgaaggtctctgtttttcatttccaagatttcgatttggttcttttttatttcatttttgaaatggttgtgaaatggttgcatttttgcctttcccagcagttcttgagtggttacggtgggtctcctccctctcagcagccaccagcccaggctgccccactctctgcccacccctttccaggctcaccgaggcctctccttcctaacaggtgtcttcatctgctgctggttcaccatcctttacctcccaagtcagagcaccacagtctcctcctctactgcaagattggaccaggcccactccgcatctcaagaataggaaggcacggccctgcaatatggactcagctctggctctctgtgtgaccttgggcagctccgtgcctctctctgtactccctcagtttccttctctgtacaatgtggctggggagggagaggatgggaccaggttggaccacgtggcatcagaggtcccatccagatccaactataggtccaagagtccacgtaagcaggtttgcaaggctctaaagttcctatagtcctgagaccccctgccagcaaagagtgacagtcacctccatgccctgccctcattgcaaagccctcactcaccttctggtctcagcaagggaggagagtctgttgctggcatagccctggaaggagcccccagcctctcccctcctcctccttgtcactggcctcccacaactccccttctggctgcctgtaaccttgaggggcattcaggaggccagcgttccctcaggcactgggggtttgttttggggggtgggagttgatcctcccacccagtctgcccctggtctctgcccatccaatcagagcccaccctcctggaagagacccccgtgttcagagtgctggcagccctgcacgtgtccagggacactgcatttcaaagaaccactgagtgggtgagctaccttgggcaaaccccccactcctgactctgactgccacgtgggtggcccgacctctgacctgctgtcatcgtagaggtagaaagcaaacaatctggggctcagcacacctgggggtgctcccactcattcagtgtgtggggcccctgagcagaggctgggcattgccactaggacctgagctcctagagaacaaggacctgggtggcctcgcttactgttccagcccaggccaagcacagggtctggctcgtggcaaaccttgaataaatatttgttggctgaa

SEQ ID NO: 12977 - DNA, 3861 bp, Homo sapiens
agggaccactggagactggtcttctgagggctgctccacggaggtcagacctgaggggaccgtgtgctgctgtgaccacctgacctttttcgccctgctcctggtaacagccccctccactctgatcccagccatcccaggggcttccagctcctgccctggggagggggctgcctggtggtctttgggtatatgggcctggcctccaactgacgtggtcccggttctggggtcacccacagagacccaccttggaccagtccacggtgcatatcctcacacgcatctcccaggcgggctgtggggtctccatgatcttcctggccttcaccattattctttatgcctttctgaggtgagtgatccccacctccccaccatgtctccctcccgccctcaagggaggcagcagggcagggtgggaagcattcaggttgtgcagcctctgaccgttgtcccctccacacgttagtgtcctcatcccaaaatggggttgggggttgaaatgtgtcagagctatttcaggagcaagtggcagaaactcaactcaaattggcttaaacataatagggaatgtgtggttcacgtaactgagaatagcaaatagcaaatagggttcatgtaattgaaaaacccaaggtgcatggacttctggcagggttcgatccagggggtcaaaagaggtccccagaacttggtctccctctacctctcacagctttgctcgccccttgacagtcacatcgggcagctttaccaccctcaggggccctggctgcctcaggattgcatcatagctccttagctgcttaggcagaaataaaagagatctcctctttccaagtattctaagatgaatcccaggattgagaaggattttattttgagataaaacagaaagatgcaaaaatagtgcagagtcctgtggttcgttctcccagattccccctgtggatacatcatagacaactgtagttcaatatcaaaaccagcagctggtggtacagtactgttgactagaatacagactttgctcagttttcaccattttttatgtacattcatgtgtgtgtctgtgtgtgtgtctgtgtgtgtgtgtgtgtgtgtgtgtgtgcgcgcgtgcgtgcgcgcaggacatatcatttgattggcccagtccaaaatgaaaataaagaaggctgggcgtagtagctcatgcctgtaatcccagcactttgggaggccgaggcaggtagatcacctgaggtcaggagttcgagaccagtctggccaacatggtgaaagcccatctctactaaaaatacaaaacaaaagttagctgggcgtggtggtgcgcgcctgtaatcccagctactcaggaggttgaggcaggagaatcgcttgaaccaaggaggcggaggttgcagtgagccgagatcacaccattgcactccagcctggacaacaagtgcaaaactccgtctcaaaaaaaaaaaaaaaaaaaagagagagagagagagaaagaaaatatatggccccttattcaaaaaattttaagaatgtcaagatggcgacagtagaacattaagtccttctgcgtatggggtcctacagaggtcacatgctcatgaaactggccctgtgtgagcatgtgtgtgcatgtctgtgtatatcagcctatgcagttttatcccgtgtatacaccagagttgagtcttactggtctaacttggaccatgtgcccatgcctgtctgggtcactgtggtcaagagctggaatacacagattggccggccaggccatgtgtctgctcttgggtttgagctaacaaagaacccctggcccctgacttatgagagtggggacgggcgttccttagggaaacctggggctgtgtccagaagaggtgggagtgagtgcaggacaggcagaaacagcagagagcactgcagcctgggcccaggccatggctgagggacccacaggatctgccagcttgaaggagcctaggggagctgccagtgctccagcttgtcctgtcccctgcctcctgggggtccctgggggtggcctaaagcagcccttgggtctcctgcccccgcatccagggccgtccctccgccctctccacgtgcctctgtgtcagcatttggccctaggctgcagccccaactaggcccacccaatccatcacagaccaacccatgagtgtaaatggtgcccctcacccccaccctccaagccctggcctaggacatggtccccatccccaacaagccgagtgtgacttgccagctggccgcattgctggaccctgtgagcggggcttggagcgccaggagaaattaccaccagctccccagggtggggcctggcatctcaggtgaggtggacatgatcccagatgctcctccaggaagcccccggctcccctccctcggctgagagcccttttggatctggtttgctaagaattcagagtgggggctccagagagagggaggtgagcctggtgagtcactggacagggagtctggagcccagggttggagcccctgccctgctctgtgaccccataaggctcccgtccctctctaagcctcactctcctactgcattttcggcttcatgcatccacccatctgtccatccacttcaccaatggatccctggtcccaccactgttaggcctgaagttcacagcatgggaaagacccgaggagagagaggatggggagttacactatgctgctgggaaatgtccagttcagctcaggctaaggggcattcagagatggcctccccagaaggaaacctccaaggggcatttgaaaggcagaagaagaggagtcaggcaaagaaggtgggaggagctggggagcagggaaaggcattgagaacagtgggaagagctgacctctgcgaaatgagatcagcctcaccttggtatagtttgggtcattccaggtgttttttttcttctcttcccaaggctgcctaatctctagccagtgtctggcttttgactgataggtgtgttgctcagttactttgggcccgtgtacgtttgtgtgtcacctccatcccataattttaagtacatgcatgatatgcagcccatatgcatgaaccttaagtagctaattatcatacagggttatgtgaaagaaactttttctctctaatgtaaatgcccatctctgaagagctgccccttactggtttggtccggatcttgccggccacggggtcccttttttatgtcacttttgtcttgcctgctgaacctctgcttttcatctcacttcttgctcacccgtcccattcaccgtgcttctattctctgcttttacttattctgccctttatccaacttttaattccctttgctattctcctgcctcattttctggcctcattttccctattatcctgcctcacattgatcaagggatgaggctggcaggatccggaacccacagggccccgtgggccatgagaggctcctggacttgaacctcaggacactcccactctggctgccggcagggatggaagctggatgagcaggcaggagctggcagtgggggtggagagccataggctattggggtggacaggcttgggtgcctcatgggagctccccatgggagctgtggccccttggggcctcttatttctcaccccaggctttcccgggagaggttcaagtcagaagatgccccaaagatccacgtggccctgggtggcagcctgttcctcctgaatctggccttcttggtcaatgtggggagtggctcaaaggggtctgatgctgcctgctgggcccggggggctgtcttccactacttcctgctctgtgccttcacctggatgggcct

SEQ ID NO: 12978 - DNA, 148 bp, Homo sapiens
tgcacctgtagtcccagctactcaggaggctgaggcaggagaattgcttgaacctgggaggtggaggttgcagtgagctgagattgtgccactgtactccagcctgggcaacagagcgagactccatctcaaaaaaaaaaaaaaaaaa

SEQ ID NO: 12979 - DNA, 604 bp, Homo sapiens
caagtatctgtttccagccaacatctctaggcttgtatgcctggtagggggacagtttcatttggaggccacacatgtttcagatttaagggatttaaaacaaattatctacctccttaacctacctttttcattttccctctactcatatgtggcagtaccatcgactcagctgtacagcctggcagcctgtgattctctccttttctctctcagttggtcaccgaatcctcctggctcttttcttttttattcttcatctttctattctcattgccacttaatgtagaccttggtattcatttcacctggtctccttgccttcgttcttgcctcagtttctcctctgccttgctgtcatttgtctctttggcttcactacgctgctgttttccttttgttgccaagtccatgttttgggacactgacatgtatggttattgacctggccaagccttatcctccgccttgacaccacacccctgtgttacatccacaccataacgctttgcggtttttcaaaaacaccaagttgttttatatttccatgttccaggggtccttgtcatttgatgaattgttaatccccaaatctcagtaagaa

SEQ ID NO: 12980 - DNA, 108 bp, Homo sapiens
cccaggctggagtgcagtggtgtgatctcggcttagtgcaacctctgcctgccaggttcaagtgattctcctgcctcaccctcctgagtagctgggattacaggtgcc

SEQ ID NO: 12981 - DNA, 3399 bp, Homo sapiens
ccttcctggcaggtgagtctgtgactgctaagacctttcgccgaaactgaagctcacgtttttccttgggcatttccttggggaagaagaagtaggggatggcagccagggccactgcaccggcagcgatgaggaaacccagccaccaggcacccacccatcgggggtcctttatggtcaggctgataccacctggaagagaagagcatggtgacattagggtcaggatgataggctgtcacttctaagccgccatcctgggactggcctctgagacatgaggtggcccaggctgggagtcaggagacctgagttccagtctgctctgccaggtgtgtcctgtgtgaccctgggcaagtccttggccctttccgagccttggcttcttcaactaccaaggcagtatagtgcagtggtcaaggccatggactctagaggcggactgctgggtctgaattccattactaactcataaccttgggcaacctacacaacctctttgtgcctcagtttttgtcctttgtgaaatatagatattagtagcttccaaatcataggactgttgtgaaaattaacgaaatagatgtgaagcacttagaagagtgtgtgccatataggtacctgctcctcctcctcctcctcttcctccttctcattactattgtgattattattcttaaatgaatgtttaggattactgttgtgtttctcagaccttcatgatgattaatatccccagggatgtttgtcaaaaaatacctggccttactgaagacccacttagaatgaccacagagtggggtgggaaggtgaccaaggaacccgtacctttaacaagttccccagatgattttgatcccccactaggtttaattgggactagattatcccaggtgtacctcctggctggaacacacaaagctcccgtcatacttcttaatcacaaggctgagttgtgtacattttccttcaatttccacagcatccaaaaatgcttcataaaaatacaaatgagctgggtgcagtggctcaagcctgtaatcccagcactttgggaaactgaggtggaagactcattagaggccaggagttcgagaccaccctgagcaacatagtgaggccctgtctctacaaataaattaaaaagttacccaggtgtgatggtgcacacctgcagtctcagctactcaagagcctgaggtgggaagattgcttgagcccaggcatccaaggctgcagtaagctaggattgtgccactgcatgaggggcagagtgagaccctgtctcaaaacaaaaacaagaaaaaccaaatgctccttgatgtaccaaccccacacacagagctggttcccctggtgcttgatcctaagctcctcccaggcagggaccagaggactcagttggcacttagcaaacgcacctgtaaagccggggatgggtttggcttttgcgctgattagacttgattctctccttacttgttatctcccctgcctccatgtcaggctggtgagagctcacacatgcacctctccaacccgtccgcttctctcttatcagtctgtgcctgcagctagcatgatctgcccaccctgtgaaatcccccatggagaagggagtttcgaggtggcaggtcggtccacagaaatgtcacatctgcctgtggagataccccgtctgcctggacaatgtcaacagagtcagaaaacacacccccttgcatggagctgaggtgtgtcagggaaatctagggaacccctgactcccaggacttttctttcaggggagggaggggtcgcagccagagcccacactctggacccagccttccagaaggagagtgggcggggcggggctgtccctggtggctgctgttcagagctgcgcagatctgttctggctggaggcgcttgtgggcaaaagctggggaacaagaagcagcgtctgcatgtccattcagccacacacatgtcacctgaggctcccaggacctggcagaaagtctgcaggtgagaatggcaggaggcacatctggagctgcttggtgcgacgagttgggagctgggatgccacagtgacgtgctctaacaggagtacgctactgctctccaaggactccagaaccctggaacccccaacacccctccctcctggccaccttcagaccaagcgtcagtcccactccttggcccactctgaccactgcctggaccagaaactactctttcccaaatggtgcccctggcagtttcctagactctgagctggtcagaactagaagggttcttagaggtcacagtaaatgtcccatctgagagaggcccagggtaatactttgagtcaccaagttctgctccaaaagttctctccagtgtgcactgtcctctctgtttaactcaagtcttgtttccccctaaaaacaggggctccctacaggcaagagagtatgctcttccacctgccccacagcatgtgtgagcagggggctgagggcctgttgaaggtggggtatggaacaaggcgaagactcccagtaatagtagtgacggcaaccatggttcctaatttgatggcactttacagtttatctccaccatctcgctggactctgatcacagctttaggagacagacaggacagagattatctcacagatgagaaagctgaggttcagagaggctaagagacttgcccaaggtcagtggtgctgctaggatttgaaccgaggtcccctggctcaatgtctcctatgagagtggcagtcagttagctagggtctagcaaacatgtgctcctgaggctcaccttctggcatctggttaatgtccacataaaggcgcagcatgaggctgcccagcccaaaggccaggcctggccccatcatggtcactgcaaacaggatccctacaacacaaagcctgagttaggatcctctggccctggcttccctctgcagaccagtgcttgcccagtctctgatgggcaagaacactctgtctcccctggtcagggatggggaactctccagggcttccctggacctttactggccagatggggcagggggcagggattccatctccagccccaaccctgggtctctcttcctcctagttgagcctggcctgaccctcagaggccaagggatggcactggtcctcaccgaggtagaggggcgagttgctgttgtgggcaaagtcatcgatgtaggagatgccaaagggctgaatgggcaccccgcccacgcccagcagggtctgtgccacgaacatgatccccaccacactcagatgctgggtttctgtgtagcttgagcagttgccattggagggggccgaggctggggccgaggttgtgggcaggcacagggaagccttgaagtcctgtggcatatcctc

SEQ ID NO: 12982 - DNA, 3399 bp, Homo sapiens
ccttcctggcaggtgagtctgtgactgctaagacctttcgccgaaactgaagctcacgtttttccttgggcatttccttggggaagaagaagtaggggatggcagccagggccactgcaccggcagcgatgaggaaacccagccaccaggcacccacccatcgggggtcctttatggtcaggctgataccacctggaagagaagagcatggtgacattagggtcaggatgataggctgtcacttctaagccgccatcctgggactggcctctgagacatgaggtggcccaggctgggagtcaggagacctgagttccagtctgctctgccaggtgtgtcctgtgtgaccctgggcaagtccttggccctttccgagccttggcttcttcaactaccaaggcagtatagtgcagtggtcaaggccatggactctagaggcggactgctgggtctgaattccattactaactcataaccttgggcaacctacacaacctctttgtgcctcagtttttgtcctttgtgaaatatagatattagtagcttccaaatcataggactgttgtgaaaattaacgaaatagatgtgaagcacttagaagagtgtgtgccatataggtacctgctcctcctcctcctcctcttcctccttctcattactattgtgattattattcttaaatgaatgtttaggattactgttgtgtttctcagaccttcatgatgattaatatccccagggatgtttgtcaaaaaatacctggccttactgaagacccacttagaatgaccacagagtggggtgggaaggtgaccaaggaacccgtacctttaacaagttccccagatgattttgatcccccactaggtttaattgggactagattatcccaggtgtacctcctggctggaacacacaaagctcccgtcatacttcttaatcacaaggctgagttgtgtacattttccttcaatttccacagcatccaaaaatgcttcataaaaatacaaatgagctgggtgcagtggctcaagcctgtaatcccagcactttgggaaactgaggtggaagactcattagaggccaggagttcgagaccaccctgagcaacatagtgaggccctgtctctacaaataaattaaaaagttacccaggtgtgatggtgcacacctgcagtctcagctactcaagagcctgaggtgggaagattgcttgagcccaggcatccaaggctgcagtaagctaggattgtgccactgcatgaggggcagagtgagaccctgtctcaaaacaaaaacaagaaaaaccaaatgctccttgatgtaccaaccccacacacagagctggttcccctggtgcttgatcctaagctcctcccaggcagggaccagaggactcagttggcacttagcaaacgcacctgtaaagccggggatgggtttggcttttgcgctgattagacttgattctctccttacttgttatctcccctgcctccatgtcaggctggtgagagctcacacatgcacctctccaacccgtccgcttctctcttatcagtctgtgcctgcagctagcatgatctgcccaccctgtgaaatcccccatggagaagggagtttcgaggtggcaggtcggtccacagaaatgtcacatctgcctgtggagataccccgtctgcctggacaatgtcaacagagtcagaaaacacacccccttgcatggagctgaggtgtgtcagggaaatctagggaacccctgactcccaggacttttctttcaggggagggaggggtcgcagccagagcccacactctggacccagccttccagaaggagagtgggcggggcggggctgtccctggtggctgctgttcagagctgcgcagatctgttctggctggaggcgcttgtgggcaaaagctggggaacgagaagcagcgtctgcatgtccattcagccacacacacgtcacctgaggctcccaggacctggcagaaagtctgcaggtgagaatggcaggaggcacatctggagctgcttggtgcgacgagttgggagctgggatgccacagtgacgtgctctaacaggagtacgctactgctctccaaggactccagaaccctggaacccccaacacccctccctcctggccaccttcagaccaagcgtcagtcccactccttggcccactctgaccactgcctggaccagaaactactctttcccaaatggtgcccctggcagtttcctagactctgagctggtcagaactagaagggttcttagaggtcacagtaaatgtcccatctgagagaggcccagggtaatactttgagtcaccaagttctgctccaaaagttctctccagtgtgcactgtcctctctgtttaactcaagtcttgtttccccctaaaaacaggggctccctacaggcaagagagtatgctcttccacctgccccacagcatgtgtgagcagggggctgagggcctgttgaaggtggggtatggaacaaggcgaagactcccagtaatagtagtgacggcaaccatggttcctaatttgatggcactttacagtttatctccaccatctcgctggactctgatcacagctttaggagacagacaggacagagattatctcacagatgagaaagctgaggttcagagaggctaagagacttgcccaaggtcagtggtgctgctaggatttgaaccgaggtcccctggctcaatgtctcctatgagagtggcagtcagttagctagggtctagcaaacatgtgctcctgaggctcaccttctggcatctggttaatgtccacataaaggcgcagcatgaggctgcccagcccaaaggccaggcctggccccatcatggtcactgcaaacaggatccctacaacacaaagcctgagttaggatcctctggccctggcttccctctgcagaccagtgcttgcccagtctctgatgggcaagaacactctgtctcccctggtcagggatggggaactctccagggcttccctggacctttactggccagatggggcagggggcagggattccatctccagccccaaccctgggtctctcttcctcctagttgagcctggcctgaccctcagaggccaagggatggcactggtcctcaccgaggtagaggggcgagttgctgttgtgggcaaagtcatcgatgtaggagatgccaaagggctgaatgggcaccccgcccacgcccagcagggtctgtgccacgaacatgatccccaccacactcagatgctgggtttctgtgtagcttgagcagttgccattggagggggccgaggctggggccgaggttgtgggcaggcacagggaagccttgaagtcctgtggcatatcctc

SEQ ID NO: 12983 - DNA, 173 bp, Homo sapiens
caagcgattcttctgcctcagcctcctgagtagctgggactacaggtgcccaccaccatgcccggctaattttttctatttttagtagagacggggtttcaccgtgttagccaggatggtctcgatctcctgacctcgtgatccaaccgccttggcctcccaaagtgctggaa

SEQ ID NO: 12984 - DNA, 173 bp, Homo sapiens; identical to SEQ ID NO: 12983

SEQ ID NO: 12985 - DNA, 1811 bp, Homo sapiens
aacgcccaggtgcagacacagaaagttctggagcttggggacgtccctgaagtcatcatctagatgcaccgggtctctttgtcccacatacatttggatgaatgcgtgcacacatactcttataccaggactcagggcccccaaccagggtatctggtcctcatggaacagtggaggcctcgtctctcccctcctgccccccactctcccccaccatctctcccctatcttgaagttgtgccaccctctgcttggcctacaggcccccatccaaaggtaaaagagctgggccatgtgcaaactctcatccttccaaactctcctcttgcctcctcctcctccaggcagtccacttggatatctatggttgggaggtgctcgatcctgtcttctacccctcagaggcatccctctctcagctgggagggtctgggaggttgacaaccaacaattggcaacaattaccatttatggagcacacactatgtgccaggcaccacattgaacctaagtacagcccaagagatagacactggtttttgcccattttacaggccaggaaaatcctgtgcttcaggtcgcaagattagaacatgtagagctggagctcgaacccatttctgtctgacggcaaagcctagcccttgactccgctcccgcagcctccgtctgggagctcttgaggctacacaagacattccaggccctagagagactggagcaccctgttcccggcagagccctcggctctgagctcggcccagcatcaaaacatctcacggagccccagctcatctcatgagctaccccatcccggcccacacctgggcacacctcccaccccagcagtgggcatgaatcaggcagggccagagccggagagaaaatgccaagtgccatgaaaacagggcaccaggccggagcagggacagagagctatagcttcgcagggacagaggggtggccagagtgacccagagagaaagctgggggaagggggcatcagggaagccccagccatccccctcccatggaaggagtgttgggggagctatgcagatacagaagtacaggaacgttcggctgcttgtatggccaggaaaatgggcgtaggtcgctgcgtgtctgagagcgggtgtatccgtgtgtgcggccatgtatgtctttgtgtgtgtcagcaaatgtcggcatgtttgcctttttatccctgtggcaaggagggggaagcacgcattggtgcatatttgtgtgtgtgtgtgtgtgtgtgtgtttgaaaaggtatttgtggccgggtgcagtggctcatgcctgtaatcccagcactttgggaggccgaggcaggtggatcacgaggtcagaagttcaagaccagccgggccaagatggtgaaaccccatcttcactaaaaaatacagaaattacccgggcgtggtggcgggcacctgtaatcccagctactcgggaagctgaggcagagaattgcttgaacccgggaggcagaggttacagtgagccgagatcacgccactgcactccaacctgggcgacagagcaaggctccgtctcaaaaaaaaaaaaaatagaaaaagaaaagttatttgtgtgcacacctgagcgagccaactgcattatgtctctgtgtaaagatgtgtatccatccatccgcctgtccgtccttgggtccatgtgagcatgtgtgggggtgaacacacatttgtgtctacctgtatccaagcatgtgctcagggctccatgagtctgggaggtgtcgtggtctccatgtgccttcgtcgctatctgtatcatctcga

SEQ ID NO: 12986 - DNA, 446 bp, Homo sapiens
ttgttagggaggggcaggccagaccccactgaccagccgacagcagccacctgcccagagctgaagggtttccctgcccaccatgaagggctggcagcctggagacaccatgcccactcccctctccagccatcctggcacactggaactgtcgtaacctgggcctacaatcacacagagccaagcaccggccatcgccctgggtctcgcagccgccccagccccttcctagccatgtcaccggcgtatccacaggcattttctctcccagggtgctgtgaaatctgaggggctggtgtctcacccaagccatgggggagcaggctcagatgtctggcgtgcttggcatgggaggccgggctggcagcctggtgggcaaggggctgcttgagcgtggggtcttggttccactaggccccaaacatcggccacacagcccagccaag

SEQ ID NO: 12987 - DNA, 705 bp, Homo sapiens
tttttgtgtatctgtcttaggcttttttatttgaggttaccattaagcttgcaaataacatgttataagccattatgttaaagtgatgacagcactgattgaaaaagaaaaaaacaaattaacaaacaagcacagagataactaataacactacatttaattttattcccctttttaactttttatttatttatatattattgtgctatgtcttgaaaagttgttgtagttattattttgataggtttatcttttagtctttctacacaagatatgagtagtttacacactacaattgcagtgtcataatattctgtgtttgtctgtgagttttgtaccttcagacaatttcttattgctcccttttctttcagaatgaagaactccctttagcatttcttatagcataggtctggtgttaatgaggtccctcagctttttgtttacctgggaaaatctttatttctctttcacgtttgaagtctatttttactggatgtactattctaggatgaaagttttttccttcaacactttaaatatgttatgtcactttctcctggcatgtaaggtttccctgagaagcctgctgcaagatgtgtgggagctcatttgtatgttatttgtttcttttctcttactgccttcttttaagattctttctttatccttgacctttgggagtttgattattaaatgcctcga

SEQ ID NO: 12988 - DNA, 159 bp, Homo sapiens
ggagatcgagaccatcctggctaacacagtgaaaccccgtctctactaaaaatacaaaaaaattagctgggcgtgttggcgggtgcctgtagtcccagctactcaggaggctgaggcaggagaatggcgtgaacccaggaggcggagcttgcagtgagc

SEQ ID NO: 12989 - DNA, 565 bp, Homo sapiens
cgtgtctcaggcaagcttacctttgtcatcagtatcaaccaccgggtaaccggcggtgatggctttttgacgagctacagacaaaaatgcattcgtcattgattagcccggctagttgtcgcttttgccgtgactgctcttaccaccttttttacctgcttcagatgcgcgctgcgggtcattcttgaaattacccccgctgtgctgtccaccttttttacctgcttctgatgctctttcgcggtcttctgcaaaattgccggaaccgcctcgatggtttgccattactgacctccgtctgggtatagacatcatattgcatagaattaacgcggcgtatggcggctgccatattttcgctacgtgggactaagcttagtgaactgacgcgggcagacccgcgtttggtaatatcctgcaacagcttcttagcgagaatagatatcatctccaataattatccataagccgctcttatgattaaaaaaacgcgatgagataaaaatgtgtcattttgcgacaaaattacgtgcttgtgaaagttgttataaatcaaataagtggt

SEQ ID NO: 12990 - DNA, 1074 bp, Homo sapiens
aatatcggtgtgatggccgtgaccaaagtctactcgacgctggtgtttgttgctgctgccgtcatcgccatgctgttgggcttttcaccgaaatttggtgcgctgattcataccattccggccgcggttattggtggtgcatcaattgttgtgttcgggctgattgccgtcgcaggcgcaaggatatgggtacaaaaccgtgtcgatttaagccagaacggtaatttgattatggtcgcagtaaccttagtgctgggcgcgggtgattttgctctcacgctgggcggttttacgttgggagggattggtacagcaacctttggcgcgattttactcaatgcgttgttaagcagaaagttggttgacgttccaccgccagaagttgttcatcaggagccataaacagaaaaccgccggggttaccggcggtgcagattgttgacaacgtacgcatgttcatgccggatgcggcgtaaacgccttatccggcctacaaaacagtgcaaattcaatatattgcaatcttctggtaggcctgataagcatcgcgcatcaggcaagcttacatttgtcatcagtatcaaccaccgggtaaccggcggtgatggctttttgacgagctacagacaaaaatgcattcgtcattgattagcccgggctagttgtcgcttttgccgtgactgctcttaccaccttttttacctgcttcagatgcgcgctgcgggtcattcttgaaattacccccgctgtgctgtccaccttttttacctgcttctgatgctctttcgcggtcttctgcaaaattgccggaaccgcctcgatggtttgccattactgacctccgtctgggtatagacatcatattgcatagaattaacgcggcgtatggcggatgccatattttcgctacgtgggactaagcttagtgaactgacgcgggcagacccgcgttggtaatatcctgcaacagcttcttagcgagaatagatatcatctccaataattatccataagccgctcttatgattaacaaaacgcgatgagatcaccaatgtgtcattttgcagacaaaat

SEQ ID NO: 12991 - DNA, 393 bp, Homo sapiens
catgtacggacatattgaaacgatggcacgcgcagtcgctgagggtgcaagcaaagtggatggcgctgaagttgtcgttaagcgtgtaccggaaaccatgccgccgcaattatttgaaaaagcaggcggtaaaacgcaaactgcaccggttgcaaccccgcaagaactggccgattacgacgccattatttttggtacacctacccgctttggcaacatgtccggtcaaatgcgtaccttcctcgaccagacgggcggcctgtgggcttccggcgcactatacggaaaactggcgagcgtctttagttccaccggtactggcggcggtcaggaacaaaccatcacatccacctggacgacccttgcgcatcacggcatggtaattgtccctat

SEQ ID NO: 12992 - DNA, 1480 bp, Homo sapiens
ggattatggaggctactataaaaattgaatgagaaagtcagtgagatgcactgtttaatttcctttctggctctttcactgtttctttttgttttgttttttcccttttccttgccaataaaaaatatttgttgagtaactcaggcctactgtacaaagtaacaattctctcctccctttccatcttcttcctctccagttctacttctgagaaagtaatccttaataacagtttggtgtgtatccaaaaaagcttttttgtagcattattctccaaagtgtttgaagcatttcttctgataaagtttctttagtctttagccagaactagtctttggcccacttagtctattgataaacaggaaatagcacatattccccccttgaggctagaatggcaggcctaaaatgagtaggagaattctgagaaatggaaactttaaaaaggcggcaaccttctagtttcattctcagaaataccaaagcagcatttttcctggacttgttctgcagagcgctcagatttgaaagccatttctagcctttgaggattaccactgtcctcagccaaactgcagggactcctaagtagatcagagctcctggaactttctcatcttttcagcatctcaaccctgtggaatcttttaactcccaaggtaagtacagattgtccagagagatctaagccatgcttattcaatggaatggagagtctctcaaagagacctcataactctaagatgaaaatctcctctgtggctacagacttttccagatatacccactttaggcaagagaggatgaagtagacactttaggtctacacttttaataaataagtgaaatagacaatgagaggagctggtccttagactgtactcaccttgtagctgaggccagggatgtaggactcaagcccagaggaacctggctgggctgagagaaagagatgtagagggttctcatagttctggggaacaaaccttcagataagacaagtgaggagacttgggaggaagggatgcctgtgaagattctcttttttttttgagacaggttctcactctttcgcccaggctgtcgtgcagtggtgcgatcacaactcactgcagcttcgaccttccagggctcaaaggatcctcctgcttcagcctttgaaagtgcggggactacaggcactgagcgtgagggtgcctggctaatttttttcgtttctgtagagaggaagtcttgctagattgaccaggctggtttcaaactcctgacctcaagtaatcgtcccaccttggcctcccaatgtgctgggattatagacattagccaccgtacccagcctcgcctgtgaagattctttagcagttagctgattgcttcatcactatgaaaaggggtttcttatttttcttatttttttttttttgagacaggctctcactctgtcacccaggctggagtgcagtgatgcaatcgtggctca

SEQ ID NO: 12993 - DNA, 302 bp, Homo sapiens
ggatggggtctttgagtggacatgctattcctgtttgttagttttccttctgacagtcagccccctctgctgccagtatactggtgtttgctggaggttcactcctgaccccgtttgcctgggtatcactagtggaggctgcagaacagcaaagattgctgcctcttgtttcctctggaagctttgtcccagagggcacctgccagatgccagccagagctctcctgtaggaggtgtctgtcagcctctactgggagatgtctcccagtcaggatacataggggtcagggacccactcgagg

SEQ ID NO: 12994 - DNA, 219 bp, Homo sapiens
aggcagtctgacccttagcagagctccaacgctgtgctgggaggtctgctgctctcttcagagccatcagttagggacgtttaagtctgttgaagctgtgcccacagccaggcctttcccctcatgctctgtcccattgagatgggggttttatctgcaagtccctgactgggtctgctgcctttttttcagagatgccctgcccagagaagaaaaatc

SEQ ID NO: 12995 - DNA, 2706 bp, Homo sapiens
ccgctgggcctctctctgtcaagccctggggaaagatgactttaccaccagcccccaagctggaagtggaatttcgggtttcttaatgggtgcgagccacattcttctcctctaaaaacagtttgaggactttccccacttaccccttgccttagtttgggggcaggaagcaggaggagacggggactgtggctggcgcttccctcaccgccccttgggaaggaccacacaggcccaaggggacgggtgaataaccgagaacaaagtcctaataaaatagtcacttttatttcttagcaaaactatttcctccgtgaggggtatttacaacagagaaaggaaagaaggggtcaattcacagcgacttggagaggctggaggggctcgtgggaggcccgaagggctggagacagacacacttcacacaattaactggaactgctttttccggtttccgacggggacgtccccagagggacttgatggggccggggccccgcgtggcaagggaactcgcacaaaccacccgccctcctgggctggcccccggtcacccgcgggtgagctctgggagttcgggctcaggacccgggaggggggtctggcaggtcccgacgcagcccggggacaggggcagggccaaggggcagggccggggcgcatgcaaacaccgagggggagcgggcaacacggaggggggcgccggcgcgcgcgcgcggcgggggcgcgcgggggcgggaccgggaagggcagtcacgggcgccggagcagcacgtgctcgatgtaattctccagctcctcctgctcctgcagccggcgctcctccgcctccgcctcctcctgcgcgcgccgcgcctgggcctcccggccgggatagtggcgcgaaggcggcaaggcgtggtggtagtggcggcggcgcaaggccgagggcggctgcagtgtccgcggccggatgtagttggggaaagggtggtacggccctggcgggtacacctcgtcctcctcccgatcccagggcgggagcacctcgttccagtccggcagctcgtctcgtgcgggagcgggggcggggggcgggggctgcggggagcggacgtgggtgggggcgggggcggcacgggggggcggcacgggctcgggaggggcgttcttcttccgcttccgcttctcctccacctcctcgatgatgctgaccacgtcgtccgctggcaggtggagtttggtggacagctcaatgaggctgtcgatcgtctgcggatccatctcctcgtcgtcctcctcctccccgccctcctctgtcccctcggcctccttccgccggtggcccggcgtctcctcctgggagcgcttgtcctcggcgccggcttccccgtcctcctcctccgcgaacaggagcgcgttctgccgcgccctctccgcctcctccgcctctgcctccgcctcggccgcctcctcatcctcttcccccaccctctcctccccgccgcgtctctcctgctccgcctcctcctcctcccttgcactctctcgctcctccgccgcctcctgcagcccccgacccccgaggccgcgctgccgggccccgccctgcagcaaatactggagcagcaggtccgaggcgaggtcggccagccgctcttcctgcgccgcggcctgccgcgtggcctccgcctgccgccgcccggcctccacctgcgccagcccttgctggagaaggcgctcgcccgcctcggagccgcccaggagtgcgctctccggccggcgcgccttggggaacggggcggccacgccttggtacgccttggacaggggtgccaatgcctcgcctaggtgtgttttgggggaggacactccttccccgaacttgtgggtttcgggaaggggcccgctgtcgggcatacgcgcctggaattgagagggggccgggggcggcaggggcgcgcgctccgggacacgcgcctggaactctccccaggaagcgcgccatacgcgctctggccccgggctctccagattcactcgggtcagcgtgtgcgtgcgggtttccgtctctgctgccgccgtctcctgctggcgcttggcgctacttggactgaaatctcgcagttcctggagcagggacgctagcgcctcgagctcctcggagggatcgctcgcctcgggcccattctccggagtctgagggcgaggcggagccgcgggctccgggctctccggcgccgggaggctgtgggtctggctgcgcacggtctcggtcagcagagcttcagctgcttcttcctccggcccctgctgggagccgcttggtgccgggggtgaggcgggacggtcgagtgcctgcagcagcaccgcggccagcgcccggggatccacgccctggaaaagctctccctcgtcctgcggctcggaattccgagcgcctcggacctctggggcgctgccatcctttggcccgggcactgcgtccccggctaccggctctttatgctcagagctgagaggaggaggctgcgcctcagggcgaccagggggtgctgcccctaacccgttgatcagcagaaggcagaagagggcggaagccgacaatctgagggctttcatgaccaagaggctgccggagactgaaaaatagaagggaccaaaaaaagaggatttctgtaagaattcccctctctaggtctacgttcccttcccccacctttcagc

SEQ ID NO: 12996 - DNA, 364 bp, Homo sapiens
gcccccaactccctgagctgcctttatggaaggaggagcaactcttcaggatgcgggtctgttgtgggtgatttcgtttgcccagtttagttttatttgaatcagttcacaagtacctgcgattagaaaaggcttaagatgggaggccaaggtggggaggtcgcttgagcccaggagttccagaccagctgagcaagctggcaaaacctcatccctacaaaaaatgcaaacattagctgggcataatggtgcacacttgtagtcccagctactcaggaggttggggtaggaggatcacttgagcccaggaagtcgaggttgcagtgagctgtgattgcaccactgcactccagcctgggcaaca

SEQ ID NO: 12997 - DNA, 537 bp, Homo sapiens
cgcccacgtactaagcagcagcaatatgggggaaaaaaaaatctctgctccctccccgtaggactccccggatggtgcgtgggcgacttcagcagcaagagaaaaagctgcgactcccccgtttaccggggacccttaccagggggctccccgctgtgtttgcaacacccccatcgagaggagagagaaccctccctcacgcccacggctggctgccgagggtttgagggacgaacagcggagtatttaccagctggtgtcacgacgcgagaggtggagaggagggtcggggcagggtggggacaggggaagatcgggacgcgtccgcctcggctccgagcggtggccggggtaggagcgacggtcgaggtctggcgtcccgtgggctgggctcagctgggtcggcgcggctccgggcggctagctcgctccggcttcagcacgctggacagcgcccgcgcctccaccgccttataaaggggagcgcgcggggtcacgtgggcgcgccccgccccattgacgtcaatgttcattcat

SEQ ID NO: 12998 - DNA, 772 bp, Homo sapiens
aatgaggcctttcttgaccatcccattaaatattgcactcttcttctgcacagacccaactcccgttgccctgttccatttctctccagagcgcttaccgccctttaccctactacagaattcacttgattttcacattaccagtttgccggtttgccatctgtctcccccactagagtgtcagctccaggagggcagagatttgggtctgtgtgttcactgctgtgtccccatgatgcaacaacgtgtgctcagtaagtgcctgctgagtgactgcatcaatgaatgggtgaatgcatcgggattaagaatatgggtatgaggccaggcgtggtggctcatgcctgtaatcccagcactttgggaggctgaggcaggtggatcacctggttgggagttcaagaccagcctgccaacatggagaaaccccatctctaataaaaatacaaaaaaaaaaaaaaattagctgggtgtggtggcacgtgcctataatcccagctactcaggaggctgaggtaggagaattgcttgtacccgggaggcagaggttgcggtgagccgagatcgcaccactgcactccagcctgggcaacaagagcgaaactctgtctcaaaaaaaaaaaaaattgaatatgggcatgggccgggcacagtggctcacgcctgtaatcctagcactttgggagaccgaggtaggcggatcacttgagccccggagtttgagaccaccctggcaacatggtaaaaccctgcctctactaaaaatacaaaa

SEQ ID NO: 12999 - DNA, 628 bp, Homo sapiens
tccctcacctcctctcccacagtgaattggatgttattgtcccggtctctcttcaggaagccgttgatattcatctggaacctagcagcaggtgcagaataggcgcaggtgaggtcccagtgtcaggggttccacagctcgtagctgcctctcctctccccattctctcccttggatctcccactggctcctctggggaccctggggtgaggaattcccccggagtccaccccagcccccgtcttgggaaagggtaccttttatctggaatgaaggtccccaggccattgctgctgatgtccacacgcatgaccacactgcctttcttgatgggcatgggcgtgtaccagctcatgctacacacttcttctgccatgcatggctctgcagggaggccctgggcactgaaactgctggggcctcccaatggccggttccaggccccagaccaccctgggatctccccacaactccccatacctgcctccacgccatgggtcccactggggcctctgtgtggcccctctaggccatggaatgtgctgagctcccgccccccacataccctcctcagatcatggccccacagaggcccccagcaaaccccacacccctgccaggttgcgat

SEQ ID NO: 13000 - DNA, 3356 bp, Homo sapiens
gagcaacagtctctgtttaagtaattcccttccagggtctctttgttacagcatctatacctggaccccaaccatgagccaggggaggattcgtttcctgggggcagtgtggaagggagtggtggagagagacaggagcagggaagagaggagacaaacagatgaggccatcagggagaaatctccttggttagagaacaagaacaaggctgggcacggtggctcatgcctgtaatcacagcactttgggaggccaacgcaggaggatggcttgaggtcaggagttcaagaccaagctgggcaacatggcaaaaccccatctttaccaaaaatacaaaaattagccaggcatggtgatatgcgcctgtagtcccagctactagggaggctcaggtaggaggatggcttgaacccaggagatggaggctgcagtgagccaagattgcatcactgaactccagcctgggtaagaaagtgagaccatgacaaaaagaaaaaaaagaaaaagaactaaaacaggatcataggatcttcttgtagtttctacgtgtggcgattgggttttcaccgtcatctgagatgtgtctccctcaagccttgttatggtgtcggcccattacctgtctgacatgaaataaaaacaaacccagggtttattttggagtgatggaaattttttggaagtagatagtggtggtggttgcataatattgtgaatgaactagatgccactgatgttcactttaaaatggttaaatttatggatttcacttcaacaagttaaaaaaaataaggaacaagaatttggatgcctgaattcacattgaacttgttttcattcctgtgaatataaacaccttctctatgaccaggtgcgatggctcacacctgtaataccagcactttgggaggctgaggcgggtggatcacttgaggtcaggagttcgagaccagcctggccaacatagtgaaaccccatctgtactaaaaatacaaaattagctgggtgtggtggtgcatgcctgtaatcctagctacttgggaggctgaggcaggagaatcacttgaacccggggggtggaggttgcagtgagctgagatcacaccattgcactccagcctgggcaacaagagtgaaattccatctcaaaaaaaaaaaaacaaaaaaaaaaaacgaagtttgtggaaattggccaggcacggtgatcccagcactttaggaggcctagatgggaggattgcttaagggcaggagtttaagaccagtctgggcaacatagtgagaccgtgtctctacaaacaattttttaaaattagccaggtaaggtggcgcatgcctgtaataccagctatttggtaggctgaggcaggaggatcgtttaagtccaggagttggaggctgcagtgagctatgatcacaccagtgcactccagcctcggcaacagagcaaaagcctgtctcttaaaaaaaaaagttggtgtaaattaaacaatgtctgaatagacttggctcagaacagagaaagctgacacaggacaggaagatggtccacaaactgaacaaattccacataagcaggaattcagagccagaaggggtcaggagaatactaatccacgtgggatcctcagaaattgtgagtagggcttttgaccttgatgggaggaggttaaggcaatctttttttttttttttttgagacagagtcttgctctatcgcccaggctggagtacagtggtacgatcttggctcactgcaacttccgcctcccaggttcaagcgattctccagcctcagcctccagagtagctgggattacaggtgcctgccaccatgcctggctaatttttgtacttctagtagagacagggtttcaccatgttgcctaggctggtctgcaactcctgacctcaggtgatccacccgcctcggtctcccaaagtgctgggattataggcgtgagccactgcaccggctgtgggtgcacttcttaaagccagttctctgggtaaaccaacctgccttggcgttctcctgtagctgcactaattccaacatagttctgtcgctgaagccaaaagatccttacttcagacactccctccctattctgggataatataggctctcaatgcctaataggaaacccttgggcagagatgtatattgcaatgcagaattttccagagtgtagaatgtaatggcacatatataccattggttatggaagctattaactttttttttttgtttttctttgagacggagtctggctctgtcgcccaggctggagtgcagtggcacaatcttggctcgctgcaagctccgcctcccggcttcatgccattctcctgcctcagcctcctgagtagctgggattacaggcgcccactaccacgcccagttttttttgtttgtttgtttttgagacagggtctcgatctgtctcccaggctgaagtgcagtggtgtgatcatagctcactgcagcctcaaagtcccaggctcaagcaatcctcctgcttcagccttctgagcagctgagactacagactcatgccaccacccctggctaagttttgtatttttggtagagatggggtctcactatgttgtccaggctggtctcaaactcctgctctcaagcgattctcctacctcagcctcccaaagtgctgggattataggcatgagcctctgcacccggccagaaactattaacttatatcatcctcacaacaatcctatgaagtaaatataaatattactcccatgttacaaatgggaatctgaagaccgggtcgttgaactgccaggtccagggtcaggcagccaggaggtggcagaaccagggtttgaacctaggccctctggctgtagaatcttgtgttttttcttcatgctatctgcctctcatggggacagatatgtctttggggacttctagagccccaggcccctaccttatttcaggggctgaggcccagctccctccaagacgccccgcccaccatctgccccacaccgttcacctccacgagagagaagtccttgaagctggtgtcagtcatcaggacgtacttctcattgggaatgcctcccaggataagcacaggtgactggtccacagtgtgccacaagggcctcgatgagacacccacaaagtactggggcatcaggttgaagagctgccaaggagggacaggagggacgccaacactctccccactctcctgagactccatctcatttaggtccaaggcctgacctggacccacaaggccccacgcgatttgtccttctcacttccttgacctcattccttaccattctccccctcggtccctctctccca

SEQ ID NO: 13001 - DNA, 1165 bp, Homo sapiens
taatgtgacatttttgactgcttatcaatatgtgtctttttttatggtttctttataaaagttccaacacctctatctttctcttattgcgtatcttacaaaatgtggaacaatttgcagaatattaatatcatgtcttaagtattgccttaaatggtttgtgggatattacttgatattcaccttcttgatagataagattcatcattggcagcaaataattaaaggtaaaaaaaaatgcctaagattaacaattttctaaatttaaagaatagaaaaaaggccaggtgtggtggttcacgcctataatcccagaactttgggaggccgaggagggtggatctcctgagctcaggagttccagaccacccagggcaacatggcaaaaccctatatctaataaaaataatttttaaaaaatctagccgggcgtccttgcaggcgactgtagttccagctactcgggaggctgaggcacaagaattgcttgagacccggaagcagaggttgcagtgagccgagatcgtgccactgcactccagcttgggctacagagtgagactccatcttaacaaacagacaaacaacaacaaaaacaaacaaaccaaaaagagtggaaaatacatcttcccccaattcacctgaactttaatgaacagtcaacatggccttcttgtatagaagtggcacagttgtcgccttagaagaatcaggaattcctccctgcattcagggaggagcatgttcgcttgttgtgtttgtttcactatttgactcaaatattacaattactacagtaattaagactaattatctcaagtccaattacatcgacagcataaatttttacctcatacagtccagtttcagtattgaaaataaaatcagtctgggcacagtggctcacgcctgtaatccctgcacttggggaggctgaggcgggaggtttacgaggtcaggagttcgagatcagtctgaccaacatggtgaaactccgtctccactaaaaacacaaaattagccgggcgtggtggcacatgcctctaatcccaagctactcgggaggctgaggcaggacaatggctctaacccaggaggcggaggttgcagtgagccaagatcaagccattgcaacccagcctgggcaacaagagggaaactccaa

SEQ ID NO: 13002 - DNA, 1166 bp, Homo sapiens
taatgtgacatttttgactgcttatcaatatgtgtctttttttatggtttctttataaaagttccaacacctctatctttctcttattgcgtatcttacaaaatgtggaacaatttgcagaatattaatatcatgtcttaagtattgccttaaatggtttgtgggatattacttgatattcaccttcttgatagataagattcatcattggcagcaaataattaaaggtaaaaaaaaatgcctaagattaacaattttctaaatttaaagaatagaaaaaaggccaggtgtggtggttcacgcctataatcccagaactttgggaggccgaggagggtggatctcctgagctcaggagttccagaccacccagggcaacatggcaaaaccctatatctaataaaaataatttttaaaaaatctagccgggcgtccttgcaggcgactgtagttccagctactcgggaggctgaggcacaagaattgcttgagacccggaagcagaggttgcagtgagccgagatcgtgccactgcactccagcttgggctacagagtgagactccatcttaacaaacagacaaacaacaacaaaaacaaacaaaccaaaaagagtggaaaatacatcttcccccaattcacctgaactttaatgaacagtcaacatggccttcttgtatagaagtggcacagttgtcgccttagaagaatcaggaattcctccctgcattcagggaggagcatgttcgcttgttgtgtttgtttcactatttgactcaaatattacaattactacagtaattaagactaattatctcaagtccaattacatcgacagcataaatttttacctcatacagtccagtttcagtattgaaaataaaatcagtctgggcacagtggctcacgcctgtaatccctgcacttggagaggctgaggcgggaggtttacgaggtcaggagttcgagatcagtctgaccaacatggtgaaactccgtctccactaaaaacacaaaattagccgggcgtggtggcacatgcctctaatcccaagctactcgggaggctgaggcaggacaatggctctaacccaggaggcggaggttgcagtgagccaagatcaagccattgcaacctcagcctgggcaacaagagggaaactccaa

SEQ ID NO: 13003 - DNA, 347 bp, Homo sapiens
cacgctgtcctcaccagctgttccacgtgctgtgcgtgtgtggctctgtagctggctggcagtgccgtgtcgggtgaagctgggagagtccctcctttgcagacagaattcctgccattcctcacttttatgactgtccaggagcaagaacgtggccttctggagttgaggtagaatgggcaagaaatcctctacatcattctatttactgctcctttgtgttttaaaaacagctttattaaaatgcatacaccagcctgggcaaggtggcaagactccatctctacaaaatatttttaaaaattagcggggtgtggtggcacacgcctgtggtcccggctgctcga

SEQ ID NO: 13004 - DNA, 347 bp, Homo sapiens; identical to SEQ ID NO: 13003

SEQ ID NO: 13005 - DNA, 776 bp, Homo sapiens; identical to SEQ ID NO: 11325
  misc_feature (709)..(709): n equals a,t,g, or c
  misc_feature (738)..(738): n equals a,t,g, or c

SEQ ID NO: 13006 - DNA, 878 bp, Homo sapiens; identical to SEQ ID NO: 11326
  misc_feature (741)..(741): n equals a,t,g, or c

SEQ ID NO: 13007 - DNA, 150 bp, Homo sapiens; identical to SEQ ID NO: 11327

SEQ ID NO: 13008 - DNA, 845 bp, Homo sapiens; identical to SEQ ID NO: 11962

SEQ ID NO: 13009 - DNA, 1493 bp, Homo sapiens
gttggtgcctatgtccttttgacatgaccctgtcagttctgcagcacttctttatatgtgttcttttgattttgcttttagataccaacctttgcagacagattagctcacatagttttgaatttagtgggaaccaaccccttgtattttgctgtatttctagtatctctgctaaattggtactagatcaggcaggatgacttaatgcaacagttcttaaacattttggtcttaggacccctttatgcatttgaaaacatcattgaggatcccaaagagctttttctgtaatgtgaattatatctgttgatatttatcatatttgaaattaaaactgataaaatttaaatacaaaaatgtgtaaccatatatcctattagccatcagagtgatgccaacatcaaacatcatatagcttctggaagacttcagagcacatttattagagaatgagagtgaaaaagtcaaataatttattggtgttatcatgacaataattttttgattatgtggaccccctgagatggtcttagggacaatgctaaagactactgttttaaagtattggcaaagaagaaaaccaccttatgggaagatttcatgagtctttctcaaaggaactccttgctaaacatctatcttcatggtacctaagcatttcaccttttaaccaggactttaggccattgtattactgggagctcctcctcaaaatgcagagaaagctcaaagactaatttttatctattgttaataattcaatttaaattggcttattaaatggcttttcagttacttttcaggatgttgagatacttggacttaggataggtatgttttatggggaagacttgggaggttatagagaaataaaggggagaaggaaagggtaattgagagcatgcctctctgctgagaaggtggctccatgtggaacaccacagccttgctttctcctctatgtctcctgccctctcaccctggctggctgctcaccaacccttccatacttatcctaaactttcaactatgggtgcttttttgtatttgtgaattagaaagaggtagcttgggctttgcatatttaagcagattgggaaagttgtaaacttttgagtcccttagaataactcagtcatgtatttctcttcttagtaaaaattcagaaaaattccagagtagtgcaaacctgcttagagagaggagaaaacagaagaagactgttgtgtttaactgaaactgaaactgcaaatgaaggggtttttttgtcattttatgttttctttttggtttgtattcctcaatccgtgccttgataacaattcataaatctaggttcaaagagtacaaaatccatattactactaggaatcataaggctttgattaaaataatttttttgaactttcttctatggctattctgagctcagaaagagtattttatttaatttttgttgtagagacagggtctcactgtgtcacccaggctgg

SEQ ID NO: 13010 - DNA, 413 bp, Homo sapiens
tttgttgagataaggtctcactatgatgcccaggcttgtctcaaattcctggcttcaagaaatcctcctgtctgggattaaagaggtgagtgactttgctcggcctttgccttttaaaataaagcttcttaaattatttcttcacagcggtgatatttttattttttgtttgttctcaaaatattccagatttgatttcatccttccctccacagttgctcaggctaataattcacttgcacaaagtcacatagagcagtgactcaatccaagcaaaccaacatttacacagatgtcataatcatttgtcttgtgaggtcctgaaggtaattaaccccatttttgtaggtgtgaaaaatcatacttttcagtgacttcatacttttcagtgactttcatacttttcagcgact

SEQ ID NO: 13011 - DNA, 18274 bp, Homo sapiens
gcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatggtgagaatctctgagaatcattgtctgtgtctggaaatactatttgcaagaatgtttggaatatagccgtagtgcccagtttttcaggattttaaccacagaaagggtcatgagaagatagcctttcttgtctactatagctgtgtttatgattatttggagagttcatggggctacactgagttctttggctggagctatcttttctctgagggatcctgctgtcaacaggagaaatttgaggacaatggtgagggcaacaagttctccataagcagtgatatgattcagacctggctttgccactagcaatcatgcgaccctagaagggtcctatccactctccactggagtttcattgtctggacaataagtgtgaaatagatcatttctagggtcacttacaacttcaactttttggatctaaggacagagccagattggactagccttgagccagttatgattgtccttctcattttgcttggggagatagctctttcaggattgataagggcacatagagcagagccttttcatacctgaaatgatgccaactaaagatataactgggcaagagcattcttttaaaatccaagaggcttagtttgatgaaattcttcttaactgacacacagctgagatgaaaggttacgaagtgagaataagagattactttggagcatggcacacacggcagtagttttagggagtagaggacaaacttatggttattaggaatattaaggtgagagtttactcatgccaataatattgcccacagggaagaaaaggcttagtagatgagaatgcaagggagataggacaatgccaaaagaaatttcttttacttattttgcctataatgagtcctctctgtagaatcttatgttgtttctttcttgatttccacttctttcattctctctttttctgtttctcctccctgtctccttccttcctttcctccctctctgccttcctttcttctttccttcctcctaatttttctttttttcttgtgtcatatttttctcatttctgttcctttttattctcttcctcttttcctcacctttctttctcttagtctccttccttcactcatagacttttgtatttttttttcctgaaaagcagatgtctctgagctttaaagctagtaattctgttctcttccacactgaccttttccatccacaccttataactttcatgtaagccattctttgatacatcataggacctcaacactcagtctggcccatcaaccatattcatgttttttcatttctatttcccttcttccagcgctcacagacattagtaatcttagccagagccacagttccatagccctacttccccaacccagtgtcttctacctgcctcttgaacctataagcacagcccaggctttcagttagcactgccatttaattatcttgtgggctccaaagccaaccacagaaagacaagtttacatctgcttagaaaagaaaaattctatattccaacaaaaatgaactcactagtcaggggattttcaaaagggtacaggctacagctggcctgaaaataattttctcatgagctagttagtttttcttaacttaatcaggtgatttccagtgctcttccaacagtcatttcttaatttttatggttattagctacgaattccaaattttggttttgtgtagctcttccaaaaagggattttccagctctcctccatgcgtctaattcactggtccagctccaagaagaaaatggctatctctaagcagtagcctttctatgggctctctgttccaaaactgccctagtgcctctgataggtacaggacacatgtatggcagtgctggttggtggttattgtcaagccatttaagaggaatacccagaagaaggcagagatgctgcattgcccctggaagagaacagaataattaggactgtttgggagagaaaagtatcatctgacttctcaatactctatgtccatctgacaaattctgctacagacaaattacagaaagggtctttctcatcacaggtttgtactaggccagtctccatcctgcagatcagaaaattagacacaagaggaactggaaagtccccagtttgggtaggatatgccatgctatctttctagcctccattatctttctataagcatatttccttcatctctctgaggagactgcaggactcagaccaggtgcttaactgataacagatcatatttattttttgtcccagtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggtaagagaaagtgagcaaggtggctgtggttgtgtctgtgtgcatggacctggaaggcagtgaatgtcctgcagaggttttcagcctcttagcataatctatttggagaaagaatggggcaaataaggaaaaaacaaaacaaaacaaaaaaattgaagaaacaaataaagcaagttttactttcataaatgtggttcattgcccacacaccaaatgctgttgctgagatccattcatttatttatttcttccactctactaacatgtaattaggtctgttctgggccagactttgagttgaacatgaaaagtgcagcaatgagcaagactcagtctctaagcttctagtctactagggaatagagataaatggatgggcaattgtaaaactgtgcattacattctccagtgagaaagctatgatgcaccatgggaggattggaggttgggaaggaggggctcaatctgggggagatttggaaggtttcctggaagaagtgacatctgtgatgaaatcactgtataatctacactgtgagaaagggacctatctgaagtgctttcgtcacccattttaaagcaaactgcctcctatccaagtccctttttgctttcttgtgtttttgtctaaactactgtctctgggcctcatagatacaagaggtgagaatgacagaggagagaataaagggagcagagattataaagacaagaagttttagcaataatagccacgtcttttctctgtgtagttttgaagcactgactcttgatgaagcagtcagtaataagcctcctaaaaagtattactcctcttttttggagaaattatgagcaataaactggaaaagctttctacacccacctctttactgcagtggcctttggagtccctgaaaacccagactaatcagaaattggatatttaggtaaatttggtcaaaaagacttgcagtgttggatttggatatttgtgaagagatcttcagattcagccatggcaaagggtatatttcctggaaaaacaagaacctaaaaaagaatgtcttttttttttccaagaatgccagatttgacttatatcacttacagtgtttatataccacttgtataatgtttgtttattctgtgaacatttaccaaaaaacttccatgctcaaagcattatgtcaagcactggacctatagaaatcaaacaaatccctgtctgaggtctgaggtgttcagttaaataatgatgtgacgaatcccattatggaggtatggagaagatgctagagactcccaaatcaaggagttcctcatttgcctttgcattgcaacatgacactgaggaactgatatttaggctgagttgcattaaagacatagataagaagaaatttaccaaaaactttgagatgagttatctctgggggttgaaatcatgagattcatgtttctttctttgtacttctctgcattttccacaatttcctcaataaacatgtattcttttaatagacagtatggcaaagaatatgtgctttagaggcaaacagactttcaaccaaaccttggctatcccatttgttattctgattttgatctcagttaaattctcaaagcctcagttttctttaaatctgttagaaaataataactcttgggatgttttgaggattaaatgcgataagtttaaagctcttattacacagtagccagataaaacatgttagctattactaatatctaaatattattaaaataatatgaagtcatacgtataaacctacatatgtatgtatttaaggataattttaactaaaagctcaactctttttgcctcaacaatttcctcatgtgatgtcattttcctttttctttcttcaatatctataggctattggttttcagttccgctattgctaagcattgtttccctggtaattcttctcgtcctaatctcaatcttactgtactggaaacgtcaccggaatcaggaccgaggtgagttgtcacagggagttcaaaaaatgacataaattaaatttgatttttaatgacaatttgtgagtcatttgaagatataaataagggaatggcaacaatgtgttttgtctgttgtttccaaaatacagaaatgttgatactgttttaaaatgcgtcggggcattttcttgcaattggacattaaattggacatttctgctttttgtttgctaagatgacttaaaagctaatgaaatcaaacaatggtgatagaaccaaagaaagaagtctggcacccacacaaggccctttccactcattaatgagaaggacaatctcttctctttttatagcacttcacaggccatctgcccatttaagaggctgcaattgtccaattatgatcactcattaagtagcactttctgtgttatactcccacgatgcctcaaacactgtcagcatcatgcaagtgatccatacttacagtaactgtgtcatgccattctgcccttctagactgtaaatttctctttatctttcacaactatcacagcatcttatatataccagggtctgaataaatgttaatttactgaatgaactgattgaggacagagagaatttttaaggtgattttttttcaattccttttctcctattgtaaattcagtacctcataaacgccagtctaagatattgtgagaaattataaaacaagagacactataaagcaagagcagtgagctagatagagaggaagaatgaaatgtctttggtttctgtagacaatgcataatttattgaagtgaatacaaagctgcagtttatgttttgtgtaatggaaatttgctagggtgaaggggtgatgtgggagtttcctccatttcagatgactgaaggataggggtcaggaaagaaaaatagttggctttgatagctattttagactttgattaaaaatctcactcattttttcctttcattttatgttttatagaaatgtttccttttagttttatgtttatatttttatgtttttgttcatgtttcaagtttttgaccactttattttgcataatcctccagattaattcttgtgaatttataaaacacccaaaaagccttcagtgtcagtggcccttttgcaaaagtaggtaaaggtatttgttctgtccaggagagaagattacaaatcagttaatcttactacacataattataagcctgtggaactcataagtgctccacagaataaaatcaaagacagaagtctgtttgattctactttatccagaaatttttcttttccaattaggaaactgaagcccagagaggaaagctgacttccttccataagtttatacagcttcttaagagcaggctaggactaaaccccggtgccctgacctctgccaaatgttcttcctgtcattactgatgccccaatgtcttgacttgaaaggagctattgttatcagttgcattcacttaatctgtgcttactgtctatgcccttttcttttggaaagtgcaagcagacaagtataaagtatttaaattcatttttaaaagtccctcttgggcaaaagttttataatgcaatctactcaagcctgaggtaaattctactggaaagagacatgcaaaataattacccttgttcattaagcaagtcttggattttctgggaaatatagtcattcaatgccaatatccgattcttgaagcaaaaagaatcagcttatttctctgcccaagtttttcctcacttatgaaataaatacctgaacctatgttgactcctgtacgcatcaggattgccatttactgatgatgtcttcatgacatatggccaattgcattaattcctctgaatgactggatttttgactcatttcttttccatttgtgttgcttacaaaagttacctgaggctgggtaattcataaagaaaagaggtttatttggtttctaaaggctatacaagcacagtgccaacatctgcttctggtgagggcctcaagctacctccactaatagcagaaggaaaaggggagccagtgtgtgcagagatcagatggcgagacaggaaaataaaagagggtgctgccaggctgttttaccagctctcatgggaactaacagagagagaactcactcacaccaagggcattaatcaattcccaagagatcttccccccttaaacacctcccattaagccccacctctaacaccggggatcagatttcaacataaggtttgcaggatcaagtatccaaactacaacaactgatttagaaattttaacagccagataatttggcatcatacacttacagctagtaaaaccaagagtcaattatgctgaagcttaaatgctcagggctaagaaaatactggttcatttagaccaaacttcaggttatacaaaaagttgggacaaagaaaagagaaaggacagaaaatcatagaagatagtgacactttttatttctaccattaacaaattctgattgatattttgtgaggaagggaaatagtcctacacatttgccttccagttgttttcatccttacttttcttttctttctctttttctttccatcatctgaaaacataaaatttccaaatgagcaggaaaacacgattggtccaaaataatacaaaggttttgaacttggtgacctcaaaaatggtgatgtgaacagaaacactaaagtgaagaggtggaactgagagagagagagagagagagagagagtgtttagagtttgtagaaaagcaaaggagacagacgaataagtttttgaatttattgagtgtgagcagacaaagaattatcttcatgtagctgtccagtagccaataataaaaatctggtaagtaaggtaagtctgttaagtaaggtcaattctgtgttgggtaaatgaccaaaacagaagtttattttaggtcataatcactactcattgctcacaaatgcctaagcaaacttacagttactgatgttatttttacgtagaagttagacgaccattacttttcttgtgatcctgtataatgccagagagcatgacgttggttttttccaactgcgaagtagcacaggccatttttctgcaccactcctgatagaattatcacagttacttcccaggagactaccacagtaagactaataagatttcaaagagcattcttttctctttcatgaatccagcactttaaaacagtaagtgagaaagaattaaaatttcctagggaaattttccaccatctcgaaatacttctttctattaaaacccagtgatttcataaagttgtgcctttcacatatatgacaatgtagttaaatttggagttgagaataatcttttatttctcattagtcaacccaccaacaattacatgcttctcagaaacaataaaagaaacttcactttgaggcagatcatcatagacaatcacctaatttttaggcagctttattttgtttggtttggtttgctttgctttggtttggttgagtcaaggctgctttggagaacaatagaaaatttagacaatcatgtaaaatttatatgccaaacttcacttttttttcaagtactagctaatccatgtagaaatatgtttttcatctgcatgagctgtatatttatcttgatttccttctcttcacaataacctaacctatgaatgggttcctgacaatgtataataacaatggcaaagttaataaaacgtcatttcctggataacagcatgtgactttctcctattttaagcttaatacttaatacaaacaacaaaggtgttcgataaacaatttgtgatgatgtaattggtcattagttgaaaggggaaaacaaaaaatatctgttcacccctcctgaaataacaacctttgctttgctcagaaagcacttttgcttcccgtacaaaggctgtatgaatgggtagccctctgtccgggctgtatgaaataagaacctttgctttgctcaaaaagtacttatgcttccctgacagaggctggatgaatggcactacccaaccccaccccagtatcctcatagttccaggaggaagaaatgtgatgctttacatgagaaaagcgataaagaatcttcattgaactgcttagattagtattgctgggagaaatcttgaattccagggctatttttccgcaaaaattttacaaattttgggtgatttacctatcatgccaagatgacatacataatcttatcacaaaacccttagcaaacagattcttaatgcctggacattcttgcctggagctgttctttgctgttctctctaacatctaaacccacatgggcatagatgacccaaattttaagtttcagtctgtatgtggggaacatctctaggaatcaagacatctcagtctcctgcccaataattcaatgtgtgttcagtcctcaaatggcatactcattcccttggctttttggccatggggcttttcaaggagattagctgtcagtacctgttagactaattaatgaaaaacaaaaaggatgagaaaatctaccagctgaaaaatcctctaacatctctgctccttttgcattttagtttgcatatatcctttacctagtgtctattaccagtttgttttgtttggaaccgctgtgcatttcagtagtatagtcacacccatataataagcttgcctctaaacagatacaaggccctagcctctactaacaaaagaagccaactgtatgctatttaaactggaaaagattgggccacttaatgaaagtactcaacatggcttacagagggggaaacatcataaatgctgtattaattttctattgcttctttaccaaattatcacgcacttagcggcttaaaacaacacacatgtattatactacagttctagagatcagaagtccaacatgggtctcactgggtttaaaacaaggtgtctgcagggagacattcctttctggaggctctaggggagaatcctttttttccctctctctcttttcctgcttttagagactgcccactttccttgccttgcatcttcaaaaccaacaatgtccagttgagtctttttcacactgaatcactctaaatctgaaacatttgtctcctttttcctttataaggatccttgtgattacaatgggcccaactgcataatccatctcagggtccttaatttaatcacatcagcaaaattcctttagccatgtaaagtaacatattcacagattcctggaattagaatatggatgtctttggggtgccattattatgcctatcacaaatgctaagagggtgtgggagtgacttacttagagggacagctgtttactgacctcccagtggaagcattctctctctgtaattccatagcctttgctctgttcctggcaactctctatcaaagaacttcaaaacctggtcagaacctctgaccaggcaaggctttattttccaggattatattttgtctctcaaatctgtaatgcaaaagcatcacttctgctttcccttgttttctatcactaactataatattacaaaaactttttttttcttagaatctcagttcttgcatatttcctgcttctccctattcctaccttttcatagaggaagcaattctgacttcctttgtcttcgtcataagcatcccgtaaacacaagttcacagggaactgtgaaagttcaaagtgggaaaattatatttatcactatgtgtggtgatagtaggcataaccaaattggtctttccccgcttatcataacgtattaaaccgggaatttctcagtccctaatacttgcagagtcatgttatgaggtcattatagattttaggagcctcaatgcttttcatatcattttcagaattcttcaaaattcccatttataggccctaattgatttcagcagcccagatgcagtagagcagttcttccactaacaatttttttaaagacagagctaaaaatatatatatttgatgaagtatattaagtagaaaaaaatgttagaaatatcagaaaaaaattaagaaataaaagtatgttcagtacaatttaatttgaataattttaatctctaaaaataaccatattgtaaaaaaatacaatttcttctagtaaataaagaacaaatgagattttgtactacaaacatgcaagacatgttttgcaaaaatcacaacttcaatgttaagttccgcatttcatgaggcacaattatggaaatttatcaatgagaggctattaaaagagagcctcttgcccctctcagtattcaaactagatagaatttcatgatgactgaccaatgctgctagttctgagtctccgtggacactagtttataaatactccaaccttctcccttttttatacaataaagagaaatgctagccttgtgttttgaaagtcctttaaagagttcatgttaaatacctttgggattatgtacacaattgtcttttaatcttttttaaaaatattacttattatgaatttttgtttttatttttttaattgaaaacagaaattttatgtatttatggtgtacaacatgatatttctatatatgtatacattgtggaatggctaaatcaagctacttaacatgtgcattgcctcacatacttatttttttgtggtatgaacacataaaatctactctgtcagtaatattcaagtatacaatacattgttattaaccgtagtcaccatgttgtacaatagatctcttgaagttattactccttatctaactgaaattcttttcatcttaaccaaggccacatgaaataagaaactgaatgtgatatttatttctacaatatttctccttcaagagtttaaagttttcaactgttaattttagcaaggatgattgcaaatgacatataaaattggttgttttctagtcagtcatttttatttgcaacaatgaacaattacttagcgattttgatcaaatcctgtcctttacaaactagctgagtacctttggacaagccatttaacttccctgtgcctccttttcctcactgagtaagatggggataataattgtaactgtatctcataagaatgttgtgaagatttaaacgggaatacatacaagtgcttagaaaagtgcctaatggccgggcgcggtggctcacgcctgtaatcccagcactttgggaggccgaggcgggcggatcacgaggtcagaagatcgagaccatcctggttaacagcgtgaaaccccctctctactaaaaatataaaaaattagccgggcgtgatggtgggcgcctgtagtcccagctactcgggaggctgaggcaggagaatggcgtgaacccggaaagcggagcttgcagtgagcagagatcgcgccactgcactccagcctgggggacagagcgagactgtctcaaaaaaaaaaaaaaaagaaagaaagaaagaaagaaaaagaaaagtacctaaaacgaatgatacgctggaacactggcctgggaggagaggggcggagtgtttatttgtagctgtcgccaacttccgtgaagtaaatgttcccaccatagcaaatttcaagctactaacaatttaaccatcagcgtgagccaataaagctctagcacaccaatgcggcagactaagtttgtaacagatgttcatttttgtaattactaaatctaaggtcctttttcgttttatcgaagtatattttcatgaattgtacaaatgttcaaggaaggacgagtttagagaggtaaatggagggacaaacaggaattgtagcagttaggacagctttgaggaagatttcaggttatctgaatctgtttggacacatgggcatgcgtatttggaagggagaagaactcatacagtaagtcttaatgtcatcaataggttcttggaaactgcgagtttaagcaaaacggcatgtaacagaaccaattttaccacaggctaaatgatagaaacaagacttaagttcctatggcatatttctagtcacaaaaacatcaccaaacttttaataaagaccaaaacatttctaatattaaacattgaaataaatgtgagttatgcatacatttaagaaacagtaacaaaaacaagtgagataattattcactcaatgatttcagttcaagggtatgggtggccagagcctatgcagctcaggatgcaaggcagacactgacaccagacaggacgtcatcccagagcagggggcattcacacacgcgcacacacacgcacacgcacacacacacagttactcagactgggaccatttggacatgccaatttacataacatgcagtacgtgtttgggatgtggggggaaccagagtatccagagaaaacccatgcagacttggggaggatgtgctaactcccacacagtggtcctggatgggaatctgttgtttttctcatcaacattataacaacatgttgtggaatgaaaggatgttgttggaggacctgctatataagtcatttcagtagcagtcttgggagaaatttgtggggacccactggggagacagaatcagaaaatgtgcattctaaaaacgtgcgtatactgaaatgaacttgtgatgcctagatgaacttgtgatgccgaaaactgatttcctgctagtgcagttgtatctctttttgaagaagagaaactgttttgcttagacattttttttgtaggagtatgggaagaaaaattactcactgaagctagtgcgagtcaagggtagagggagggcagttcctgtaaggatgtgtataaatggatttccaggaaactaaactgccgcatgtcaggaagagcggctacctgaaggtgcttgtagatccaaagctgccctaggttccccatcagcactgattcatgagttttgcatctagtttctcctgtccttaccacaacttggctgttctgtcttctctgcactaaacaacttcttcactctctattccatatgttttaaacttatcttactatttttgttccctcataccttgcttcatagattacccaatccaacaagaaacaaaagagagaaagaaagaaaagtgagaggaaagaaagagagagaaagaaagagagaaacaaaacgaaagtatattcctgaaccacacaaaaagacaaagaatcacattctctacaagtgtcctgtgtttttgcaaattaaccggtacttcaggtagtccttaggtattctagagtttagaagaatcctaaaaggttttgctctggcaagggctgtgagtaaagcatggcctttgaggcgatggagggagaaagatatatagaaactttattttagagaaaggaaaaacttcttcagaccagatgcagaatcaagtaatcaaccattcaaagtcaggcttaatttaagagctttttttaaaaaaaacagacaaacaacaacaacaaaaatgtatactagtgatctttaaaggaaaccatgctatcatttagattattattctggattccagtcagtagttaggtcatataagaattataaattctgttattggtaattgatagttcaaaatgcatagtctcaccactcagggaaaacagcacttagatttcagaagataaaactttgtaagtggggatgaaaggagggcatggagggtgttcttaaatatttaaatggatgttcatgagacaaaaggactagacctggaagttattacatttaattctcatagcaattgataaggaaagtatttccatctgataggtgataaaaccaaattcacagaagttcaattcattcattttataagtatttattaataatttttaatatgcttggcattgtaattagcactggttattatactataatgaacaaaacaggaccttgtcattttaatggagatgacaggttagggggacagcagagaaatgacaagtgaatcaacaaataaggatactattaaaacacgagattttagcacaaggaaataatatagaataatataaaatatagcatgcaatgaaagaggataacttgaaaaggataccagttacttggattttgttagggaaggcttcgctgaggtggtgacttttaatcagagaccttcaaggagagaataatccagccatggaggagacaagggaagagtggtttttagcaaattaattgcaaatgtgaaagctctaaggcagaaaagtcattaatattttacagggtgcggtggcacatgtctgtaatcccagcactttgggaggctgaggcaggcagatcacctgaggtcaggagttcaagaccagcctggccaacatagtgaaaccccatctctactgaaaatatgaaaattagccgggcatagtggcatgtgcctgtactcccagctactcaggaggctgaggcaggagaatcacttgaacctaggaggtggaggttacagggagcagagattgcgccactgcactctagcttggttgacacagtgagacttcatctaaaaaaaatatatatatatatgtatatattttagagcagtgttactcccaatatggtctgaggatggttgcccatccaagaagtgttctttactagtctgaagtaaaataagtacataactgagaaaaaatgcttacactctatgataagaatttgacagtaattttatatctgttaaatctgataatttaaaaatgaattatgttattttatgtcatttttctagtaattcgtttttactattgaaattgaaaaatattgagccatgttgggagaagatggtctttccatggtccattgatatctgatgttagaaatattgggcaggatctaaaatgtgcagaactttgcaggttctggtaaacaattacctaagattacacagagagtgagaggtggtgccaagataaaattccaagtcttttacttcatcgtctatgtgccttgagaggtttccaggctcccagtatgtgccagaaagccactagcccttggaaaggcctctacttcgtgaccatttctaccctgacatccagtgagttattatccatcagaaacaaagcttacaaatagaatacattttgatcatttggaatttttgaacatattcctttacttgtagtcttaggtgattttctaaaccattatttcctaggattacgtatgcccttttatttttgcttcagttttgtttttgtttttggttgttgttgttttgttgtttttagagatagtgtcttgctatattgcctggggctggagtgcggtggtgagatcatagctcactgcagccccaatctcctgagctcaagttatcctcacgcctcagcctcctgagtagctgggactacaggtgcatgccaccatgtccagctatttttttttttatttttattttttgtagagacaaggtcttactatgttgcccagactggtcttgaacttctgggctcaaatgatcctcccgcctcggcctcctaaaacactgggcttacagccacaagccactgcatccagcctacttttgttcttgtaaagagtcatagtcccctcacaccatactgggtcagaaatgtctacttctttatctttgccaatgaatatacactagaataactctgtgtttcttaatctctctattatttatcttcttaaaatgtattatgatagaatttacaagtgtccaaagttaataccttgtttttcttttatccagagccctaaataagtcacacagcaccctgaaagtgattccctggtctacttgaatttgacacaagagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagttcctgcttactgctttgctaatagctggccttgctagaatccttggtttcactgctgttcttcatgtgcttctatgagatttactccaacacaaataggactgaatttattgtgaagtaacattggcaatcttaacttattcatttaacttatttttatagctagataaatattgttagtcttagacaatagctcacattttttgagaagcatgccctccctgtccatttgtcttataacatgacccagccctattttacgtcattctaaattcagcctcatataatgaaaatacattatgaaaacagatgtttaggagatttcctgtatagcagtcagccaattcatatgctttgtctctgctggcttctttttccatgcgttaacttttcccaatagcagaggaggcaaatatgagcatacaatccctttgttctaaagatattgttccagctagtggaatgatgttgaatctttaataaccataattagttgctttttcagtatcttctgctttgtctgtgtctatccagtggcctaggaattaaagtgtaagttgttttcgctgttaaattggatatttatatatatatatagcaagattttcatgtgttatttaattctgtattgtttcttatatttgtagtaaaatattgaacaattaaaagtgttgactccaaatatttggcttatgatattctcttgggaaatgtggaaatgaatgataatccttgtcttttcccatcatatgtaaaaccctcccctcctctctatctttcccctcctaaaagatgagctgggctgggcgcggtggctcaagcctgcaatcccagtactttgggaggccgaggcgggcggatctcgaggtcaggagatcgagaccatcctggctaacacggtgaaaccccgtctctactaaaaatacaaaaaattagccgggcgcctatagtcccagctactcgggaggctgaggcaggagaatggcgtgaacccaggaggcggagcttgcagtgagccgagatagcgccactgcactccagcctgggcaacagagcgagactcggtctcaaaaaaaaaaaaaaaaaaaaaaagataagctggtgtt

SEQ ID NO: 13012 - DNA, 10143 bp, Homo sapiens
caggtgatggatctcggccgcgacgccacccgccgcttcttcaactggttttactggagcatcaacctgggtgctgtgctgtcgctgctggtggtggcgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccaggtaaggaggggctctgggtgcagggagcctccaagcctggagaagcgctggatcgctcccggggaggcatggtccaggttgcagacattctggttcagctacagtgatagctttttatgatgatctgctctccagtgggccagagctgcccgctgtgactgaggatggaggtcaaggtagtggtggtagtggtggtggtattattggttgccatctacgtacagaatgtgtgaggatggggctgggggcggtggctatccctctaattccagcactttgggaggctgaagctggtggcttgcttgagcctgggagttcgagaccagcctgggcaacatggtgaaacctcatctctacaaaaaaatacaaaaattagtggggtgtggtggcctgtgcctgtggtctcagctacttgggaggctgacatagaaggatcaatcgagtccaggaggttgaggctggagtgagccatgatggtgccactgcactccagcctgggtgacagaacaggaaaaaaataaaaaaagaaaaatgaaaaaaaaggaagtgtgaggatgatcagggtcttgacagtgaagatggtagtaaggataaggatgatggtgttggtatctacactgaagacacaaacattggcaatgcggatgacagtggcattaaaggagaggatgatggggatgatgtttccaatgaaggctgttaggatacaatgtaaataattccacattaccctgttactaaccatcacagcgtcttaggaaatcggccaaactcgctccctcctcattagctgacatccaaaggaggaaggttctgaatgacttgcataggtcccatggcttcctttgcccctcgccttcctaaattaactgtctacttatgccaagcaaatctgtctccagaccttgcagccagttacagctcctgtcaataggatctaaatgaaaaaggtgaagaacatgctttccccagtctggcatattgctagaggtttgtaagttgtcaggagccgagaagtgtggtggttttcattatctatcgctgcctaacaaaccacaccagagcttagtgatttaaatgacctttttatctcctctcccagttctgagtgactgggctcagtcgggccgttctgcttctcgtgatggcgctggggttgcagtcatttgggacctggaaagggctagaacttctgagtctgctcacttacatggctggcagtcaatgtgggctgttggctgtgagctcagatgggactgtgtggaccagagcaccttggttcccattcgtgtggtcttaccatgtggcttgaacttctcacagcgtcgtgtgagggttccaagaggagggagctttccaagaatgaatgttccggggaggaagaaagcagaagttatgggtcttcttaaggtccttaagaggcgtgaagtcccagaccaccacttctgcttcattctaacaggtcaagctgtcacaaggccagcagggaaacaatggcagtgaaagtaaactccacctgttggtggcaaaatggcagcacacgctgggaagggtggagttgacagtggctgtctttggagatgactacactaatattgtcccttttggaatctcaaaggacagtgcaaggctcttggacaaaaagaggtcagaaagctctcaggacaaagggcaaagggcaaagggtaaaggctgcagcagtgattgatcaatcttgtcgcctactgatattccctctacccccacctctccactctctatgccttgtcatggagggagagggttgccatgttgactgttgaggaggatggacttgagacagcaaggggggggaattttggtgtatcaaatctgtgacagcgtctctctctgagtcaggcttggactgggactcccctggttcccgtggcaaattgatgctatgagccaaaaaatcccttcagactgttttccacagtctctggtcttacttccctcaggactcagaggggccacagctctagagcggaatgagtcttggctaggcacttttgcagcaaaagagaggatagaataatattggcagtagtggtgccaacattgaaaaagagtgatggtgatgtgaatggaaactccgtggagaggacgattttgctgacagcagtcaccttactaaaggtgatgatagtaaggatgctggccttggcgatggtggtgatgatggcgaaggtggtgctaacagcggggtggaggagatgagggtactgatttcagagacgtgctgatactgggaggaggattaaattagggggtgatggtagaagtgaaaacgttggctgaggtggtggggaagattatggctgctgcgtttgtttgtttgcttgttttttgagagggagtctggctctgttgcccaggctggagtgcagtggcacagtcttggctcactgcaacgtccgtctcccaggttcaagcaattctcctgtctcagcctcccaaataactgggactacaggtgcacgccaaaacagcctggctaatttttgtatttttagtagggacggagtttcaccaccttggccaggctggtcttgaactcctgacctcaggtgatccacccgcctcagcctcccaaagtgctgggattacaggcataagccaccaagcccagccttgactgttgttttatctgctgcctctggggtctcacagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccaggtgagcatacctgccctttttctctgggggcctggctccccactcaccatctgaatggcctcatttctcatcacagaggcccagggcatgtggaaagggggaaagtctgggaataaagtgaggtgctgccccgtaccagctagcatggggcctggcacaaagccgtctcagcaatccaactccctcggtggtacggcaagaggaactctggagacagcttcctcctgctatacctcctgcgggagttgaattactgggatggctttgtgccaggctaggtcttgaataagtcacctcatctctctgggcctgtttcctcatgtgtacaatgggtggcttaaacgagaggcttttccagctctgctgcattcagatatgtccgacttggtagctgaggcctagagagggtgtgtcagttgcccaaggccccacggcaggcaggtcaggggcaagctcacaaaagtgagtactttgcaacagtggttccccagcctggctgtgcttcagaatcaccggcagagcttttaaaaatatgctgttttaaaaacagattccaagtccaaccacaggctattgaatcagaattgctggggaagtttctagtttaagaaacttttcagatgatacagatactcagagttgagaactattgtcttccactcaccatattactcctcagtggggaggttagtgatgtgtttgtgtgtgtgtgtgtgtgtgtgtgtgtgtgtgtgataggagggtgggcagcagcttaatgctagcccccaggccataaggtcattgccttccatacccccttcacaggaacatttgttggagctcccagcctgctacttaggggcacacagtatttctatgatgagatggcggcatgtggtgggagggtgtccatggctgattctcagtcataccaatcagatactgacttccttccataccagttggtaaatggctgctgccctgagcagtccacatgctctcccctgccccagcccttcctgtgggagtctcctggatcctactccattatatagcaactaaaggggcagtgcatggtattggaggtggcccctgggccctgctcctgcagctgtgtccagagccattctggcaagtccatgtctatgcagtgcttgtgtcaacctgtggactcagcttggcttcagtgtcagatgagaactccctgtgggggcagccattatctttcccatttcagcaaacatttatccatgcttaccctgtgctgggccctggggacacaaatactagtcagaccagctgtgcctgggctctgggataaggctgcacgcactgcctacaggcctgagagcagagcacaggaagctccctgcccagcccagctacctaggagaaaggagggtgggaaggtgactatctccctgagactgggagaggggacagctgcccagctgtcctgtggtacggcgctgaggaatgccacctaggagttgggagggggcatggccgtttctgttccagcctcacccctgtctctcttggcagatgcagtccacctatgtcctgcagggtcttcacctccacatcccaaacattttcccagccaacccggccaacatctctgtggccctgagagcccagggcagcagctacacggtgagagataaagcatgtgttcggcacccagttcagccaggtagcggcttcctctgagaagaggaggaaatgaaactgccttcacactcccctttcctgcctgcaaggcaacctcaggatacaggaaaagcacctggagggtgggaggacttgtgtcacagcgcagggatcctgccaagatgctcaactgcttgaaggaattcaggccagctgcacacccccatgctgctgctctgaagcaggtctcgctgcctaatttgcaccctcagatcaagcatacttaggtcccttttcaactcttccttgtcccctctttctctgggacccttagatacctagatctctgcctttcccagaactttctaaaccagttccttggcatttcagactcatgaaatgaatgatctgcagagctggcagatatatgagaaatttgccattgtagtccatttccttgcccatggcagacatcactagtcaatcatgactttttttatgctgagcccataaatgttccataatcagccactaccaattgataaaagttagaatacaagaggaacctatttgccatctctacataatcccactccctggttacacagctgaggagcatgaactccagagagggaaaggagctggaccccagggtcacccagggccagtctagagtccaggtctcctgactgcagccaggctccttgcactctgctagcctgcctctcctgacttcctcctgcccagatcccggaagcctggctcctcctggccaatgttgtggtggtgctgattctggtccctctgaaggaccgcttgatcgaccctttactgctgcggtgcaagctgcttccctctgctctgcagaagatggcgctggggatgttctttggttttacctccgtcattgtggcaggtgtgcagaggggtgtggggcagggggctgaactttgggcttggggaagtctgcttccaccatgggctgatgctgaagtggtagcctggaccaagttcagcctctcccagtgggcgtcagtgttggcttcccagaggtgcaagctgaaagagaccctcctatctaatccagctgcccctcattttgacagaagaagaaactcaggccgagagaggaacaaatattttccccagtgaattatcagctccttgaaggcagagatagtttttctttttttattcactgctatgaacatgcacgtgggccctccataaatgtgttgaatgaattttccacttagtggcaaatgaagacttaaaaaaaaattatcttccttcttccatttcaaaaggatctgaagccatttgttacaaagtgggggttggtgggggcagtgggggggatcagctaaagaagtctttcacactgttgcacaaacctgaaccctttttacttagtaactttatgaccctgaagttccttagagtctctgagctatgtctttaaaatggggacaggtgtcattcggaccctgagcagggctctgcccttgtggaactcagtctgatggggggtgttgtgaggattacagcagatgaagtctgtaaagcactcagtagtgtgcctggatcacaagtatgagctggagaaatgaaagctccataaacggtattgtgttgaaagtgtgaaaacccaactagattttatcccagctatatccttaaagcagtttgtcctattttatcctcacaataatcctgggaatgttattcctgcttcttgagtaagggaactgagtctagagaggttaagtgatttgcccaaggtcacacagctagccaggctgggaacccaggtcccccaactccatgtccaatgttcattccactagagcacagctatctcccaagcaacacaggagaaggagataacatagttaaacttgaaagccaggttagaaacactacagcaatacttgacgttgcagtagagaagtcatgtgatatcatggaaagtaggccagctttgaaaccagacataccagagctcaaatccagccctgactacttatcagctgtgtgactgtgggctagttgcttaactttctagttaagcacttgaaagtgctagttatttcactttcttccgcagcaaggatgcatggtaaatgcctagcacataacaggttctccattaatgagagttgttagtgttattgagtgcaaaactcagcttggagcttctagcagccaagaccaaaagggaggagttggtcacatcttggccccctcctccaccccccagtccagtattcttttccttgcctgctgctcaatctttggctgcttcatgagtaccccatccccaccatgtacaagctcttctgtgggctaagctgcctggggtgggcctgactataatccccctctgctcctccaccaggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggtacctggatcccctcccctgctcctgcaccagtgatgggctctgcccggtggcacctcaaagtcaggtaccccagggatgcagcctccagggcccatctgcatggaggaaggcagtgttttctgaccagggctcgttcacccaacgggggtctataattagcacctggttcaagtcagcccctatgtgacaggcactggggatttggaggcgagcaagaaacttcccacaccagctctccacgtattcccctggtgccaggttctccaccctctgtgtctttgaagttgctgttccctctaccttagactgaaggtgaactccaatatcccttcattctgagcctaaataccaaggtccttgggcagaaggggtcctcccttcccgccccgtgttcatctctctatcatagcacacagtactctgggtcatagtaatggatttctatgtccttcgctccccaccctcccaacccccttccccgggctgggagctagagctgcaaggctggggcaggcccttcagtcagcaaaaaagcaagggcttcctcagctgcgggcccagggctaggctgggtcagacataaagaaaagactgaccctgggagctcactcagatggggagagagtcaggcaaacagtgagccagtggagtgctgtggaagtcagggcagagtgcagtgggagcccttaagcatggagaggaggcgggcaggtgagtgggtaggaggagcggtcttacaggcagagggaacagcataagcaaagacccaagccttgggaagcgtgggggatagggctggagaggcatgggaggtgcagggagccgaagtgtcgaagggctttgtgcgctgagcctgcaccttgggatttctcctgaaggcaacagcgcccctcctctccaggggttttggccgggaaaggaccccatccgaggtcctttagactgatgctcctggctgtgtgaggaggacaggagtcaggggagtttaagaggcatttgcagaaagtgaccagggctggggttggacccagggcagagggaatagagagaaggacatatatttagaatagatttcagaggctgtatcaaaacaatttgacgatgacattgaaggtgggcagagagggtggggagagagaggaggtaaagatggtgctgtcactgaaatgatagacctggcaggaaggggaggaggggagacagagctattggggcagcgcatggagtaccccggtgcaggggttcagccaggaggcaggtgagcagggcagaggggaaggcggcattgatgcatgggtgctgtcattgccactgagtggacaggcatccaggggaagcctggagggtggcttggtgggggcagggtcaggggcagcaagcaggggcctgggcctgttctctgcgcctgcaccagcccctgagatcgtctctgctccccctctgcaggcctggagtttgcctactcagaggccccgcgctccatgcagggcgccatcatgggcatcttcttctgcctgtcgggggtgggctcactgttgggctccagcctagtggcactgctgtccttgcccgggggctggctgcactgccccaaggactttggtgagtatggggcctccccaggagtgggacatggatggagggaggcttggaaaggaggtggcaactgctaaagtgctttgactctggggagaagcaagtagagggctagacttgggagaatggggttctagcccgggcttggccagtcacccacagcgtggcctccctccttgggcctttctttccccaagtgttgaacttagtggacctccaaggctcctttctgcttctggaactctgccatctctggctgaagggttacctttctcatggtgtttatatttcacgcccccttctgaatagctgaagaggaattgtagacacccctggagatcttcaggaagtcaaacattagtgggtatctgtccagtgtcttcagatcccaccactgcccacatggcctcagttgccagccccagtgctagtgacacggcaggcacagggcgcaagacagaggatccctgtactgacccaaatctaacccctcctttccccaggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataaggggcatgagcccttcctcacgaccatggtccatgacaaggggcagggcagagggggcctggatgggagtccttgtgggggaccaggcaggggacttggatcaacaagcaccagacgagtggcgggggcaggcgagaggctcagtgggacctccaccctcgttgccccagctggtggctgaccaggtggctgtggagggtcaggagctgccccggatcctctccatgtagttgcgaagctcctcagggtccttcagccccatgtcctcacacacccagcggatgtcctcctcgcctgccacaaggatggactgcacagcaggggcccctacaggctcctcaggtgactgggctggaggggctggcacaaagtgtcacaaagtctactcgcttccgtcgccccccagactcctttcgggccagggtgcttgaggagctggtggtgcccccag

SEQ ID NO: 13013 - DNA, 288 bp, Homo sapiens
ccgggcacgatggctcacgcctgtaatcccagaactttgggaggccgaggcgagcggatcacgaggtcaggagatcgagaccatcctggctaacaaggtgaaaccccgtctctactaaaaatacaaaaaattagccaggtgtggtggcaggtgcctgtagtcccagctactcaggaggctgaggcaggagaatggcatgaacccggaaggtggagcttgcagtgagccgagattgtgccactgcactccagcctgggcaacagagcaagactgtctcaaaaaaaaaaa

SEQ ID NO: 13014 - DNA, 7307 bp, Homo sapiens
tgatgcagaagaagagccattttattaggtgaggcacatgggatgttacacacgcctggtgggaaaggagagggggcaggttcctcggagagaaggcaactgtgtcatcttccagcacatgggccagccatctgtgagcactgggaagctgggccagaggaaatggattgagcagcaagaaatagttctgttgggggaagaccctaatcaggatggagactcaaggtcagtgagcgttactgatattgactcatcatcaaactcatgccccagagggacaggaggaggctgagaccctgggcaagccatcaggcctggagtcagggctctgtgagcatgtgtttgagtgagtgtgtctgtgtatccacgtgtacttatgtgtggtgagtccactgatgtgtgcatatgtgtgagggtgctgggtgagagtgtgtgtgtctgtgtgtggtgagtccaccaatgtgtgcatgtgtgtgagtgtgctggtgtgagagtgtgtgcatctgtatcagtggccatgtgtctgggcatttgtgtgtgtgtttctcttggtagctgtgttgctgtgctgcctgcatccttccacctctgtcagcttttctgtggatttctctgtgcatccctgtgtgtacctctgtagatgtttgtctctttctttggatgtcattgtcccaagctcccgtctgccttctaccaggagaagaacagccagcccccaaaaccctggggtgtggggaagggcacttaccagctcagcagaggccagccccttcctggaaggcttagaccttgatgacaaactgtagtccgtggatcagcatgtctaaacaaacaaacaagcaataaaaaaacagacgacagttatgatctcaacgtgaaggagtccatattcctcaaggtggggggccagggaatggaggcctctggagatccgactgtgttcagcatgcttggaggaagccaggcctccttctaccaaccagcccagctgtcctcagtgtcagggctgaggcaggagacacggtgtctatctcaaaattatctggattattcgggggaaaatgaagcccaaaatagagagagttgaggccagagggacctagtatcctagggtgtgcagggaaaaaactccttgggggaagttgctgctcctgcagagagggacagagggcttgaaagcaggtacttactaacaatgtcatgcaccagggtgatgtccaagcctctgagaacctcattgaccagagggcacacctggccaggggcagagaggagagttaggcagagtggcaccctggagcagcagaatccctagtgggggttctctggggaaatttcctgtcatttttctgtgtgaaagtgattctaagcaatcccacagatcaatggtcacacatgcctgaggagaaactggaggcatgagggatgttgtgaagggccccaaatcacacaacaagcccagtgttcaccctgtgacatcacatctgattctaagtggagtggagtgccctggttataggagacacccaagcataggttgaaagactgtctgtggccatagaaggctggacagggaacttctccaatttctcagaacaggggccaatccatttcagcttcagtgtggacaagcagggcctggcctagagcagagactcatcaatgcatttggaaagatgtaaagaagaaacatggacagatggatcaatggacaaatagattgatgaatggaagttacttatcaaattgagggactcggacccacttagctcagggctttgttttagtgcaagaagctctaaaacctgaggatcaggggatccccaccttgcctacttacgttgccctgaaccaactcaggcaggactttattcaagatccctgtgaggctgtccagaagaccttgaatggggagggggccaagtctgaaagagaaaagtcatgggtgatgcagggacctggagatggtgtggagaagtctccagagggggccactgtgaaccccacagtctcaacactcagtcactaaagccgagccttgtctatctacacccacgtgcaggccaacagcaagggtcttatgtaaagggagttacatttgtgtacagcagtgaacacacaggtatgtgtaggataaacacatggttctcagaaaaagcaggtgccaataaggctttgcagagtccataaatgaatggatactacttagtatgtagttgtcattatgatccaatgagatgacacatgtgaagcccaatgtatgtgttcattaaaagttaaccacgtgggcaacttttgcgtaataggtttgacacagtctccccatgtgacaggtaactgaaataaataacctagttaggatccacgtctattttaccccttactgggacaaagcactttcacacctgttatcttggtaggttctatcaataactccagtgcagttccatattgcagataagtaagcttagaactaaattggagaagcactacccaggttcacacaggaagccctctatccccattcccctgtaatatgcagggcttaaactccaatttcttgttgctagatccagcataaaattggttagcttggtctaagaaggaataagtactactttatctatctatctatctatctatctatctatctatctatctatcatctatctatccatccatctatctattcatccttctctccatcaacccaaccatctaaccatctgtccatccatccatccatccatccatccatccatccatccatccatccatctttccacgctccctccttcccatccattttcccaccctttcagcctctcactcatctattctctcattgtctcagctttccaatcatccatccggcatcacaccctgtcatctctgggcaggataagctgctcctctggcctcacccatcaagcagagaaatttgcaggcttccaggggaatgggtgcagtcaccaaggaccaggtggatcctctcctgcttatctctcacagctaagatttctgcagtgatgtccagcttcacagccagcctcaacagacttgcaccgaccaggggcctgcaaaggagacagccccactggtatctagctccaccacattccaaggaagagggttattttctccttgccaagaatgctagcctcacctcactccatcttgcccacagttgtacttatctcattttctagcaggagaaacaaagacttaagaggtcaagtgagtttcccaagtgacccaaggccacttagcatagcagcaaatgagctgaagttggaggctcaggtctgttagactccaatacccccgttatggttaaccatggtcaccagggtctccctcggtgagccatcctctcaccccctcttgggacccactcacgtattcacttggagctttatgccgagagggatggtgacatagagacggtggccatcagggctctgcacaaggccaagttccagcagctgggggtcagtgacctttatgctgtccagggagtaatattggagggggaaacattagctcctctagctccaaacccagaaaccatctttaacctaacagtacccatcccagaggtagagcttcccacccaggatagggagatgggaggggagtcttgcagcctaagccacgtgggttctgagtcacacactaggtcttttccagcctctgccctggaacagatctgacacacacacagggccctttccttatctccagtctatgaggtattcaggacaacaactgtgtctggattatatctgcatcctgtatgccagctaagagccttacaaagaaagtggctacttcatattagttgactggattgatgggaaggtgggtagtggatatgtgggtacatggatggaagagtaagtgattaggtagaaggatggataactggatgatggattggtcagtggatgaatggatgatgcaggtgcaactggaagtaaatctgcacaaacatttatgggtaagaatcactcaccctgtcaggtggccaatcaccaatgtttatcatgggaattgaggagcaggaagtcagggagagtgcagaaagggtggaaggaagccattctcccattgtcctatctttccaaccatccatccatcatcacaccctgttgtctccaggagaagccaggcctgtgaccgcacccatcaagcagggaggccatttgatgggtgaggccattcactgagccagccactgcgccaggtgatttacaccttttccagtcctcacaatacactttctctgtgggttctataatctatattttacagatggagaaaccaagcacagagagacagggtgtcctgtcccaggtcatccaacaagtacatttgaaaatcaaagtcaagaagtctgtctgtctccaagtcagggagtgagaccctgggtgggtaggattttggaaatggctttgatccagtcctatccaggaaccaggctctgccggctcactggcatcaagcttccattcttgctttttgctttgcgagctcttgggtgtctcatgggaaactccacgttagacctttccatggacatcacactgtttttcatcacattgatatcatcaaggtgggcaggttatactctcgctaacatcaaaggccgtctgtgttctaagggatttcacaggtgcagagaacaaaatgaccacagtgtagtgggaagagccttggctttggagttaggatagtagagtgagagccttactcacttggcatcactctagcagcgtgaacacaggcacctctgtgctttggttttcccatttgcaaactggagattattaaatcgacctcaaagggttgtggtgaggattatagatgatgctggggcctcaggacatgcctagaactgagggcattgctggtttggggaggacgggtgtccctgccaaactggagatgggtctcagaactgagtcctggctccatcttcaggccgctccctcgctgcttcagggtcgctgcttcagggtcactgcctggggctggcagatcttcacctggggttccctggtggagatcaaagctctattttaggacaactcactcaatgatgttgttcaggccaggaatcactgacgtcacttttccaagcagtcccccaaggaggccaccagaagtacctcctccaggcttcaggatgtccaggagcggaaggttttccagaatgcccaacaggcccccagacagcaggccattgctgagggctggaaatgggtgtaagggtctctgggggtcagatctgacaattccagatcctcaggccccctcccccatccagccctgtccctccccactttgcagggttggacacacacacacacacacacacacacacacacacacacacacacacacacacatgcacacatacacccctgaaaactcaccatttgtcaagcttcctgcaagacctgtgggactcaagggcagggctggattcacattcaagggcagggtctggtccaggggcacgggcaggcctccaaactgggccatggtctgggctaacagcccgtagaagacaatgaggcccccagtttgaaacatctttgctcttagtatctgtggccagaatgacaagtccaacatggcatgggtatcagagaggaatttatccaccacctgccctgacacctggggggtggggttgtttgctccccagaacaccagggggtcactagtaatagctaatactgctgaacaatttctctttgccaggcaacaggctgaccactttacacaatttcatcttcatcacaaccctaagacatgggcacctgttacctgcattgcacaggtgaggaccactgatcaggggcctaaaaaggagacagccccactccaccacattccaaagaagagggtttttttccttcttgccaagaatcccagcctcacctcactccatcttgcccacagttcacttgtctgattttccagtaggagaaaccaaggctcacagaggtcaagtgagtttgcagttgggagtttcaaatatactcccatcccttcttgaaacccacttgtgtactaccgagtgtgggtaactttccccaaggtcacaagtacacggtggacagaggattagaagctagagccaggtgaaccctcggttaaattaagtaaccatcagatttattctccaatcgggcttgcttcaatggtttgaatcattgctgctcttcagacaaagcaaatgagaagggttaaacgtgcaagtgctgaagaattgaactgttttagatcatccctgttcagtcctttggcctgagctcaggccatgatggttggtggatgcccttgaaagtcacacaatacaggggtcgcatggccacagccaccatctcatgtagacctttgttggggaattcctggggccatcaaagtcttcattgcatgagaagaaccaggagaccaaagaggggtagtgactttcccaaggtcatacaataaattgatggcagagctgtggttgaaggcaggtctcccaaccctcccctcacccaacacacaaacatgcattctatcattttgacacctttctcttctccttcaagctgccctggatggaattccggtcaacccctgaggtttggcttgcagacctctcacaggtctatttggcagccagcagagttgtccagagccagcactagtacctacaatttggagacaactggtgactttgtgcaaaattccatctattggctgactcagctaaagctccatccttgtggtggaaggctggaaatgaaaggtctttggtccaaagagccagttgtgcccttcttagggaggtaactttgaccacagcctctgaatctcttttgggcaacagaccctttatgaatccaatggaagctaaagatcctagtctcagaaaaaatgcatcaaaatgtataaaattgggtgaagaattttaggaggtttttggatcatctgtatccacattggtaacctcaagctaaaacttatgccttagaggctttcatttacggcattaatagtgcccatttctatatcaatgttactggtctcttaggacagcagagcaaatggccatccccacatccctgacattggccaggtctgtttctcttgcacagcccccagtgagtgatcaagatcactcactgccccacagggcaggagcctgagatccctgccgttaagggtagcagaggggccacagaatggatggctcttacctggacttcttagaggtctcagcagctgtcctggtctcctctctctcc

SEQ ID NO: 13015 - DNA, 8431 bp, Homo sapiens
tagaaaaccatcgagtcagaaaccgtgcggacgagcgaggtgctacggaagaagcttggggagctgacgggcaccgtgaaggaggtaacagttccacgcccgcctggagccgctggggccatcaaagtcccctggccgctggaggctggaggaagagtcggctcctgggtgggggtggcttggcagcagtgggtggcatggggcgtgctgccaccctcgggaaggtttcaggagttcccggcacatgcagggtgaggtcagactggcaaccttgcatgaccgttgacccagggagtcggcagcagtaagtgctgctagccaggactcgaggagaacatgaaaatgtttttcctgcctaaaaataggaggagaggggccgcttccaccccctcccgagggtagaggcgggaggcaggattcctggggtgctgcggctctcctcggttgtctgttctgtccagctttgcgcagcatggggcgccctcaccgccgttctttccccggggtcccctccttgggaatccttgctgccaggcagttcccgggtctccagaggactcctgcccattttggaaaggggccagcagacccagcgtctcacccagagcccaggccagcatcccggaagccgtggcggtgtgctcatggctctgggggtgccggtgtgctcatggctctgggggtgccggtgtgctcgtggctctgggggtggcggtgtgctcgtggctctgggggtgccgttgtgctcatggctctgggggtgccgcgtaccacaggagcacagaaggcctctgccggcctcggggaaccagatccgcccttctctccggcaggaattcattcctcctgccccgccccccggccgccagggccggtgccaacgccccctctctgtgtctgtctcagtagagccttcacgaagtcagtaaaagtgatctcggccggaaaatcaaggagggcgtggaggaagcagccaagacggccaagcagtcggccgagtcggtatccaaaggcggggagaagctgggcaggacagcggccttcagagccctctcccaggtgagcccagtcctgggctagggcatgcagcctggggcggccgaacccagacacccaccccagccccgctgtgcctccctcgcagggggtggagtccgtgaagaaggaaattgacgacagcgtcctgggacagaccgggccctaccggaggccccagcgactccggaagagaacggagtttgcgggagataagttcaaggaggagaaagtgtttgagccaaacgagtaggtaccagcccgtggccctcgctgcccccattttgggcagctttcactgctgtccatttcgggagcccaccaatggttccctcctgagtccgtttcttgagtttgccttctgcccaaggttcccggctccctcgaatttgagggtgagaggtgagggcggggtcctcagagcccctaggtttgaggtctcagctgcctgctgtcctgtactgccccctgcctgcagccgcaggagggcacagggtggccctggcgccgccgctcaccccagggcccaccctcttccccagggaggccctgggggtcgtgctgcacaaggactccaagtggtaccagcagtggaaggacttcaaggagaacaacgtggtgtttaaccgtgagtgaaggtgtcttggagggcaggtgactgtgtcccgggcagttggtggaccgcaaggtgatccccctgcattgggcacaagacagccccgttttgcagaggaggagatcggggtcagagtgggccggtcacttctttgcggtcacatgatggtggggctgtagattctgccgccagaagccaggtgctccctcataagcacagtcagggccccgaaacgagccgcaggcccctgtcccttgtcctgtgaggactgctagaggcctgtgtttcctttgtagtgaaagcaacagccagtggggtggcggcccataacttacacagccccattagggccgcagctgaggggcctctgcgcctggccaggtaggtgggcaggcagcggtccccaagcacagatgaggatgcaggtccacagccgtcccctccctgaccccacccgtgtcagggtggatcccgcaggggtcacagggagcctctagaagctgtgagggagggttgtgtttctggaaggggccccttctccagcacctaccccatcttccacagggttcttcgagatgaagatgaagtatgacgaaagcgacaacgcgttcatccgggcatcccgggcccttacggacaaggtcaccgacttgctgggtgagtgagtcatccctggacctcgcaggctggtggtggggcggggtccccggccttccccccgaactcccggctctgctccctgcagggggcctgttctccaagacagagatgtcggaggtgctcacggagatcctccgggtggacccggcctttgacaaggaccggtttctgaaacagtgcgagaacgacatcatccccaatgtcctggaggtgggtgccacacccccaggacccctcccaggcggcaggtcctggctccaccacctcccccgccgcagccggcaccctgggtgctgccagggaactctgctgccgaggctgttttctgaggaggctggttgcacacgggctcctgcccggctgcagctgccccatgagctgtgcccgaagcccttcctgggccttaccggcacctccggtacctccaggtctgtttccctcactcctcctgcctgaggctgttgttcctttgaggttgctgggagcagctgctggaggctagggattgtctcaggtgcctggagcccctcaccccttgggagaagtgggcgtctgtcttcagacatcagagctggccccaggccacgtctgacccagagctgcagccgtgaggttccctcacggtgctgtccctggcaaccagacccttgttgggcttatagatgagggtatcttgctcaaggtcatgctgcagcctgccccctataagcctctccctgaggttggtggcctcttgtcttccctgctgcctctgcctctctgcagcccccaggatgcaggaggagcctggacaccttcggcccagtcgggccaggcctctggaaggcccttcatgggactctccatccttggccccgccggcctccgcccaacgtcctcttcctcctccagtttcccgtatccttcccgccacttcgggcagggctgggaggtggtgcggatgggcgccatgccccaaaacagcagcctgagcaccgcagtgccttccgggatgggtgatgggtgccaagtgttctggccacccgccccctgccgctcacagctttcaccaccagcatccggctccttcccgctcttctccccgctccaggcacctccctccccctcatcggatccggcccaggctccaggatcctgtggaagcagctcccagcccaggcacgccccctgcagcccacccctccctctcgctgcccccagcagttaggaggcagccggtcccatggtgggccttgcagtccgaaatgtggtcccctggggggacagaggacatgggctcactgcgggagccggagttgggtcctcatctccctggcttggattcctgaccaggctgaaagctgggtccccagccacctttctcttcctccaccaggttccaggggggtccccctgtggggtgcctcctgggtggtcgcccgcaggccgccctccgcctgtgcctaggccagagccaggcactgacaccagcagggacgggcctgggggggacacccagtgccacagctccacccgcgccccacaggtggcagccgggggtgtctgaggaaactccccaccccgcaccactggagaatgttcccaggacctcgcctgctgcctgaaaagcccactctcgttctggtgcttattttcccttcctttttaggccatgatttctggagagcttgacattctcaaagactggtgctatgaagctgtgagtacttcctttctttttctttttttttttttaaggcctaaaaaatcaccatggagaagttccacttcggtggctccgttggggtagctcccaacaggcaggacctgggctcccggtgggggaatcctcacgtctcaccctccgagagcctgacatccccccctgcccctttccattcctcagcatgtgacacatctgggctctcaggctggacaccgggtcacccgccagtcctttgctcccagactgtaaactttgttagggagaatccttctctgggctggtgtctaagagatggctggttgggggtgtcccctgggcctgtgagagatcacaaagctgccaattttactgggccttttttttccctccaatcttaaaataattttggttaggtctgggcacggtggcctatgctttcaatcccagcagcccaaggcgggagattgcttgagcccaagcattcaagactagcctgggaaacatagcaagatcccgtctctacaaaaacatttaaaatgagccaagtggcagggtgcggtggctcatgcctgtaatcccagcactttgggatgccaaggcaggcgattgcctgagctcaagagttcgagaccagcctgggcaacatggtgaaaccccatctctactaaaataaaaagttagccaggcatgctggtgcatgtctgtaatcccagctactggggaggctgaggcagtagaattgcttaaatccgggaggtggaggttacagtgagctgaggtcgcgccactgcacttcagcctgggcaacagagcaagattctgtctccaaaaaaaaaaaaaaaaaaaaaagagccaagcatggaggcaggcacctgttgtcccagctattagggaggctgaggtgggaggatcacttgagctcacgaggtcaaggctgcagtgagtcatcgcagcacagcactccagcctgggtgacagatcaagacactgtcactaaggaaataggtcgggcacggtggctaacgcctgtcatcccagcaccttgggaggctgaggcgggcggatcacctgaggtcaggagttcgagaccagtctggccaacatggtgaaaccctgtctctactaaaaatacaaaaattagccaggcctggtggtgggcgcctgtaatcccagctactcgggaggctgaggcaggagaatcgctagaacccaggaggcggaggctgcagtgagccgagattgcaccactgcactccagcctgggcaacagagcgagactgtcttaaaaaaaaagaaataataatttagggaaggagagtcccaggagaggtggttgcagccatgaagtaaaatgaggtgtctgggggccgactgccctatttcaggtggctgcagtggcctggggtgcaggctggggccgggggtcagggacagtgtgggtctcccacatgactgggggggggctgggagtcaagtggggtttgaaggtgtcacccatcccacttcccaggccagagcagagtccctgtgctcacctcccacgggtcgtgagaatgaagtgtgatcacagaaaccagggcagtgctggccccgggccagagggaacccacagaggtaaccctggtaaccaaacagcccctggaagagttgggggagctttcatcggtgacccggggccgccacctatggggcacggatggggttgcggcagtgggtgcccctccccaggccctgggagcctctagctgtcctcacgacatgatcctgaaacatagatccaaacaaaacatcgatagtcttcccacaccaggaaggagctgtgtcctgatgaggcctcagctgcttctcagagtcaaagcttggggttcgggggccaccagcagcaccgcgtacctggggtctggtctagctgtctgccccatccctggcagcctccctgtccctgcccgagtccatccctgtggggctcccagctctcatctcctcaggccacctcatctcaccctattcgctccccgacctgtgtgtttctttcccctggcttcttcgtattaagcgatccagaatcgttcttggctaattctattctgcacccagctcataaacaacttggaaaaagcagaggagaagatgtcagattttctttttaaatactcccctgcatggtgactaatccagcaggcatttatgagtttcgatgtggatttttttttttttttttttttttttggttttttgttttgtttttaccttgggaccattacgccacagctgactcgctttgccagggagctgctggtgccctggaaacacagctgaagttccagccacgtccacagaagtgtttttaaaatgtcacctttaagaaaccgaacaagtaggattggctctgttttttttttctctcccctccgcggatcagtcatttccataaaaagtagatgctatcagaacatcttttctctcatggtttcatgccaagcccagagaaacctccagcgaaaacgtgtctcgggggctgcttcctgtgcctggcacaggcgcagggggttgagggtgacactgggggctggtcagtgacagaggcagcctcaggctgaggacagatcctagaagaggcgtttgatctcaggccaagattcagagtgcggcgaatatggaagtattaaagatcagccaaggggccgccagcttagccctgggagtagatttgggattttgttccaagagaatcacccactttgctgattaatcctgttttcattgggtcatctggatagagtgttgttcccaggagtgggaagcgtgtgatctgggccagtaagtgggtggcacctgcctccccacttggacctgggttcttggcctctgccattgctggctggcggcagggcacctgggcgccagggtgtgtgggcagcagctctgtgtggcgtggtgcccaccctgggtggcatcacgcaggcgtgtcggcctctcattgcagacttacagccagctggcccaccccatccagcaggccaaggcactgggtctccagttccattctcgcatcctagacattgacaacgtcgacgtaagcacctcgcagtgggggcccgggccaccatcgggggtgggaactatggcccagacaaggcccaggaggtggccttgccaggggctgggggccatgggctgatccaagaggtcttgggcttgtccaaggggagggtctcgagggaggcctggtcctggcctgagaggcaaggcccacggggagggaccggtgctgggcctggtgctggagccttctcctagcagggcctaggcgcaggggtttcacctccaggggagcagccgggctgtcctctgaggcacatcccccctctcggcccctctgcagctggccatgggcaagatgatggagcaggggccggtgctgatcatcaccttccaggcacagctggtgatggtggtcaggaaccccaaaggcgaggtggtggagggtgacccggtgagtgagggagtgggatggggcaggcacatgacaccgcctgtccccaagatctgtgtgtggccacctggcagagaccccagctcagagccctgaagctctgggactgggtggggatgtggagaaacctctgggccagagtttggggttgagggaggtcggagaccagcagacctgtctgtttttaccaaggctgagtggttcctgagtctaggcaattgtgctggcctctgctcccagcccctggggaagttgccggtggctcctgccccacagagcctggcccccccccagagctgcctgggtcacctcaaccctctcaacagtgcccttcccaccccaccctgcaggacaaggtgctgcggatgctgtacgtgtgggcgctctgccgagaccaggacgagctcaacccctacgcggcctggcggctcctggacatctcggcctccagcaccgagcagattctctgagtgtggtgccggagccaggtagccccggcctgggtcatcaggcacagaggcaccgcaacaccacctgcggcaactccagacctctgggaacaagactgcgggctctgcccccagctctgccaggacggctgcaagaccagctggcccgggaggggacaacgggctgttgcgggtgcgcggcagctggagacactcccccgcagggccaacccctgccctgttgctctgccctgcaggggtcccggcgcctggtcacctggggtgcacacaggtcacacagtgccaagaggccccagggcccagggactccccccacagcagggtgggacccgggacccgcggctcagtggcccgctagccacgtcagccaagccactttaggtccattttttaattttaacagtgctcttccatcttgtgcataagcctgagatttggaaagaataaaacaccgaattgcagaagagcag

SEQ ID NO: 13016 - DNA, 17003 bp, Homo sapiens
ttttctcaggcttgcgcggctctaggcgaagcggcggatgacgcaaccgggccgcgccgcgagaaggtcacacgattctccaacatggcggcggcggccctgcggagtggctggtgcgctgtccacgggtgagcggcggtgcggcgctggcagggcgagcttaggggtcttctgggccttcgccaccaaggctttcttctcagacccttggccttcgcgacccttgcttgggctccttagaaagcttggggttagatctttgggtagcagaggccaggacagggggcacagagcgtggcctgagggcggggaccgagcttaccgggcagggggcggcgatgcgcgggacctgggagggagctgatcacccttcgccctctgatcagactccacgtatacaggagagagaatggtagccggggcggcggcgtcccgtggaaaaaagtagaggggaaggcaaaaaaacgtgaaattcacagctcgcggttaaatgccaagttctctaccgagagcatttcttgtctcgtttcttctaacgttcattgtggatgtgcgagaggtggttcgcgccctagcaggctcttgggtccacagggcagtggcagtcaagacgtgtaaggcgcactcagaaagtagtacttcatattgctcgtgctcttcgttttttcttttttctcttttttttttttttttgagacagagtttcgctcttgtcgcccagtctggagtgcaatggcgcgatctcggctcactgcaacttctgcctccttctgcctccgggttcaagcgattctcctgcctcagcctcaggtggatcacctgaggtcaggagttcgagatccactggcccacatggtgaaatcccatctctactaaaaccccatctgtactaaaaatacaaaaaaattagccgggcatggtggcgcgctcctgtaatcccaactacttgggaggctgaggcaggagaatcacttgaacccggcaggcggagattgcagtgagccgagatcctgccactttactccagcctgggcaacagagggagactccgtctcaaaaaaaaaaaaaaaagttatcctcaagtaaatacaggagatagtaggcacctgtgtaagtttgggatgttgcatagggttctcagaggtaggaggcagagaacagagagaaaaacggcccaggaaatgtggaaatggtggagaagttgtacctggtcttttgacatcaacacgccaggttctgtgctgggtgacagggtgccgagctgaacaggacctgcacagagctttttttttttcccccaattttttatggaggcagggtctagctatgttgcccaggctggtctcaaactcctgagctcaaacgatccttccgcctcagcctcccaaagtatcgggattacaggcatgagccaccagctcagtgcctgcacagaacttaaggcaagatctcggctcactgcaccctccacctcccgggtttaagcaatactacaggtgtgtgggactacaggtgtgtgccaccacgcccggctaatttttgtatttttggtagagacgggatttcaccatgttggccaggctgatctcgaactcctgaccgggtgatcctcccacctcagcctcccaacgtgttgggattactggcgtgagccaccgcgcccagccagcaagtgccttttacatgagatcagcccagtctttgcccagagcgactcccctaaattactctgtttatagctcaacccttgaggaggacattgtaggtttattccagagttgtccctggggcaacacattatcgatgtttgtgtctgaaaaatccagttctctcatctttggaggctggcagaaatggggtgggctcgcaagagaagactgcttgccactagcatagaagcttagagtgcctactttcagactaagggattaaattgtacatttagccttcttccccccatgggttggcatttcctgggacctgtccgttttcccccagtttcaggggcacgaggatagatgtaggccctggaggtacagacacagcattttctctttccaccagcttctgcttgcttctcagactttgggaagattacagagtgcccggcatgcatcaggcataagatacaaattggccagtgaggccaggtgcagtggctcatgcctgtaatcccagcactttggaaaaccgggggaggggtggatcacctgaggtcaggagttcgagaccagcctggccaacatggcaaaaccgcttctctcctaaaaatacaaatattagccggatgtgatggcgcatacctgtaattccagctactcgggagactgaggcaggagaatcgcttgaacccaggaggcataggttgcagggagctgagatcgcagcactgcactctagcctgagactccgtctcaaaaaaaaaaaaaaaatggccagtgagttcgaggtgaccctgctgttttgtgtgtggtctgcttacttctcagtcaacctcttgttagaatggatctttctcttctctccccccaattagagatgcctcggcagtggaatccaatttctttccagccacaacctaccccatgggtcgacctatcagatgcgccggccgggcggagagctgccactggtgagtgactcaggatgctcgggccagcagacacaggggaggcccgaaaattcagatcccattggcaggagggaggggtggggctgtagaggtggctcgtaccatctcggtggtgggccttctgtgtccggggctttcagaatgacagatcccagtgtgcctggccttctcggtcccagaaacacttgacctgcctcttgcttgatgtcgtaaggggataaggtgctgtcagaatagccctttatgttggctctaatgcttggaagagacccctgtattgaactgaattctacttccctgtgacctctgcccgtgggtacctcaccaagcatagctgtttccttttctagaagatagccctttgatcattggtacagagtcaccttgtcacaaccagacctcagtttctcctggtcattcctcttcaactgtgcttctgttggtgtctcagcatcgtgaggacagaagcccaaaacctgactcccttccccagacctgtacattcgggcagcgcgtacattctgtctccctctctctctgcgcccagagcctcagctcagctgcctccttggaggcagctacctacctctccagtcctgtcctggggccatcgtgggtgtgggacaggacctgtgactctttccctttcttgtctagtcccccgccacacactcactcccatggtttgtagcccaagagtctctggtagggctgcgataaggttgtgtggtcctggatgattttacttagaacctgggtttcccctggagaaaggctggccagggtggcatctgaatgggactgcagcctgctgacaggaggcctggccacctgtcctggggagcagcactgggcttttttttttttttaagatagggtctcactctgtggcccaggctggggtgcagtggcactatcacggctcactgcagccttgaactcctgggcttaagcgatcctcccacctcagccttctgagtagctgggaccacaggtgtgtgactccacggggcctgagcaccaggctggatgcagctttctcttgtagcttgacaggagccagggagggggatcccacctggagctggtatacccaacacagctgtggaaaagttgaccacaggcggccccttccgcctgattggattattgtatgatcattcattaaactgtttctctgttgtttttttgaaacagagtctcactctgtcgcccaggctggagtgcaggggcgagataccgctcactgcaacctccacctcccgagttcaagcagttctcctgcctctgcctcagtagctgggactacaggcaggcgcgccacacctggctaatttttgtatttttagtagagacaaggtttcaccatgttggccaggcttgtctcggactcctggcctcaagtgatccgcccacctcggtctcccaaagtgctaggattacagatatgagccactgtgtccagcctgcttttttttttttttttttgagatggagtctcattccatcacccaggctggagtgcagtggcacaatcttggctcactgcaacctccggctcctgggttcaagtgattctcctgcctcagcctcctgagtagctggcattacaggcacccaccaccacgcccagctaatttttgtatttttagtagagacgggggtttcactatgttggtcaggctggtctggaactcctgacctcaagtgatccacccaccttggcctcccaaagtgctgagattacaggcaggagccactgcgcccggccttgttttgctttcacaaggctttatcttttgagcagttttaggtttacagaaaaatccaacagaatgtccaaagagttgccatgcccctcctctcccatctggcacacagttttctattcttcacgtcctgcattagtgtggagcatctgtcacaattgacaggatgttgatacattattattaataaatgcatggtttaccttccggttccctcttggtggtgtacattctctgtgattacagtatcataagagtagtttcactgccctaacatttttctgtgttccccctactcatctcaccctcttcctaccaacccctggcaaccactgatcttttactgtccccttagttttgccttttccagaacggtctatagttggaatcagacagtatgtagccttttcagattggcttctttcacttagtgcaatatacatttaaggttcctctgtgtcttttcacagcttgagagcatatttcttgcttgttttttaaattattttattttattttatttgagatggagtctcgctctgtcacccagactggagtgctgtggcataatcttggctcactgcagcctcttcctcctgggttcaagcaattcttgtgcctcagccttctgaggagctgggactaaaggcacacaccaccatgcccagctaacttttgcatttttagtagagatgaggtttcaccattttggccaggctggtctcgaactcctgacctcaggtgatctgcccgcctcagcctcccaaagtactgggattacaggcgtgaaccaccgcgcccagcctgttttttaaatagggtgctgtgttgcccaggttggtcttaaaactcatgacctcaagcaatcctccctcctcagcctcctaaagtggctgagagctcatttttttttcagcactgaataatattctgttgtctggatataccacacttttatcacctgctgtttctttgttttttatgattattataaaagagatagctaatcatcattaaatgtatatcaaccgaaaagagaacatttaaaaaaatccctgagtccctctgtggggcatttcattctatgttctactatgttctttaaattttttttcttgtacattctttctagtccaaatcatattcttctggaaacagaaaaggctttctgtccggcttgctagataatgtcaaacaagaattagccaaaaacaaagaaatgaaagaaagtataaaaaaattccgtgacgaggccagaaggctagaagaatcagacgtgctccaggaggccagaaggaaatacgtgagtttctttgctgcttttttttccctcacccaggctggagagtagtggtgcgatctcggctcactgcaacctccacctcccaggttcaagtgattcccctgcctcagcctcctgagtagctgggcttacaggcgcgcaccaccacgcccagctaatttttgtatttttagtagtgaagaggtttcaccatgttggccaggctggtctcgaactcctgacctcaagtgatccgcccgcctcagccttccaaagtgctgggattacaggcgtgagccaccgcgttgggcccctttgcttcttacctttcttggttgacatgtttgtttccagggccagggtttctccaggccagggacagccagaggagctcagggctggacggttgggggcagggtggctcgtgaggaagtgaggtcactgctctgatgcactaatgagagggagccaggggacaggtgcgggtctccaggcctctgggttctgccatgagaccatgcagcgttctgtgcagcttgaagcgtggtccccagaccagcagcagtggctcctcctgggagtggatgagcagtgcagaggctcacaccctcccaaactgccaggccagcgcccgcatcttcacaggcccccaggcaacgcatgcacaccagctatgggatgcagcgctcctgagagctcccagctgtagccctctgagtggagcctggtggaaactgggtgatggtgctggtattttattttattttattttattttatgagatggagtcttgctctgtcatccaggctggagtgcagtggcgtgaccttggctcactgcaacctccagctcctgattctcctgcctcagcctcccggatagctgggattacaggcgcccaccaccacacccagctgatttgttgttgttgttgttgttgttttttgaagcagagtcttactccattgcccaggctggagtgcagtggtacgattttggctcaacacaacctctgcctcctaggctcaagcgattctcctgcctcagcctcccgagtagctgggattacagacacacaccactactgcccagctaatttttgtatttttagtaaagacagggtttcaccatgttggccaggctggccttgaactcctgacctcaaatgatccacctgccttggccttccaaagtgctgagattacaggtgtgagccagtgcgcccagccctatatatctttttatagagacggggtttcaccatgttggccaggctggtctcaaactcctggcctcaagtgatctgcccgtctcagcttcccaaagtgctgggattacaggtgtgagccactgctcccagcctgtcattattaattgtcacttctcttcttgagcagctgccaagccctggcttctgggaatggctctgcattcctttatttgtaagggccctgcgaggcagttacagtgtccccattttaccaatgagcagctgagcctcagagatgcaggcacctgccacgggtcccttgcattttggtttggtttggtttcatttgtgtttttttgtttgttcgttttttgtttttctcctttgagatggagtcttgctctgtcagccaggctggagtgcaatggtgcgatctcggctcactgcaacctccgcctccctgggttcaagcgattctcctgcctcagccttccaaatagctggaattataggcgcccaccaccacgccaggctaatttttgtatttttagtggagacggggtttcatcactttggccaggctggtgttgaactcctgacctcaggtgatccatccgccttggcctcccagagtgctgggattacaggcatgagccaccgtgcccagcctagtttggttttttgagacagggtcttgctctgtcaccctggctggagtgcagtggtgtgatcacagctcactgcagttttgaccttcccatgttcaggtgattctcccacctcagcctcctgagtagctgtgactaaaggcatgggataccacgcctggctaatttttttatatttctagagacagggtctcgccatgttgcctgtgctggtctcgaactctctgggctcaagcgatcctcccatctcagcttcccaaagagctgggactacagctcacatgcccagcccctctttatcattaatgcaggggtcatctgaagacatagcaggctgagtttggagtgggatggatggagcgggagacataagaccaagctgtggtggctggaggctggatgaggggcacagtgatgacaggcaaggccacctcctaccacccggtgaaaggtgaaggctgggcctcctgttctcaggaggtagctgccaagcggggacccgagtctgccggccttctgagcaaggagctcaccgctgctgagaccctcaatccaagccatgtgggcagccgggggccctggaggcagcacatgcagacaggtgcggggagggaggggctgcggagaagatgcttcttggacctttggctgtaagagaaatgtcactgccgtgtcagaacatacagacttaaagacacaacggttggccaggcacagtggctcacacctataatcccagcactttgggaggccgaggcgggtggatcacttgaggtcagaagtttgagaccagcctggccaacgtggtaaaaccctgtctctactgaaaatacaaaaattagccaggcatggtggtgggccctgtagtcccagctactcgggaggctggggcaggaaaatcgcttgaatctggcaggaggaagttgcagtgagccgagagcgtgccactgtactccagcctcggcaacggagacattgtctcaaaaaaaaaaaaaaaaaaaaggacacagcgctctttacctagaaaaccatcgagtcagaaaccgtgcggacgagcgaggtgctacggaagaagcttggggagctgacgggcaccgtgaaggaggtaacagttccacgcccgcctggttagccgctggggccatcaaagtcccctggccgctggaggctggaggaagagtcggctcctgggtgggggtggcttggcagcagtgggtggcatggggcgtgctgccaccctcgggaaggtttcaggagttcccggcacatgcagggtgaggtcagactggcaaccttgcatgaccgttgacccagggagtcggcagcagtaagtgctgctagccaggactcgaggagaacatgaaaatgtttttcctgcctaaaaataggaggagaggggccgcttccaccccctcccgagggtagaggcgggaggcaggattcctggggtgctgcggctctcctcggttgtctgttctgtccagctttgcgcagcatggggcgccctcaccgccgttctttccccggggtcccctccttgggaatccttgctgccaggcagttcccgggtctccagaggactcctgcccattttggaaaggggccagcagacccagcgtctcacccagagcccagggccagcatcccggaagccgtggcggtgtgctcatggctctgggggtgccggtgtgctcatggctctgggggtgccggtgtgctcgtggctctgggggtggcggtgtgctcgtggctctgggggtgccgttgtgctcatggctctgggggtgccgcgtaccacaggagcacagaaggcctctgccggcctcggggaaccagatccgcccttctctccggcaggaattcattcctcctgccccgccccccggccgccagggccggtgccaacgccccctctctgtgtctgtctcagtagagccttcacgaagtcagtaaaagtgatctcggccggaaaatcaaggagggcgtggaggaagcagccaagacggccaagcagtcggccgagtcggtatccaaaggcggggagaagctgggcaggacagcggccttcagagccctctcccaggtgagcccagtcctgggctagggcatgcagcctggggcggccgaacccagacacccaccccagccccgctgtgcctccctcgcagggggtggagtccgtgaagaaggaaattgacgacagcgtcctgggacagaccgggccctaccggaggccccagcgactccggaagagaacggagtttgcgggagataagttcaaggaggagaaagtgtttgagccaaacgagtaggtaccagcccgtggccctcgctgcccccattttgggcagctttcactgctgtccatttcgggagcccaccaatggttccctcctgagtccgtttcttgagtttgccttctgcccaaggttcccggctccctcgaatttgagggtgagaggtgagggcggggtcctcagagcccctaggtttgaggtctcagctgcctgctgtcctgtactgccccctgcctgcagccgcaggagggcacagggtggccctggcgccgccgctcaccccagggcccaccctcttccccagggaggccctgggggtcgtgctgcacaaggactccaagtggtaccagcagtggaaggacttcaaggagaacaacgtggtgtttaaccgtgagtgaaggtgtcttggagggcaggtgactgtgtcccgggcagttggtggaccgcaaggtgatccccctgcattgggcacaagacagccccgttttgcagaggaggagatcggggtcagagtgggccggtcacttctttgcggtcacatgatggtggggctgtagattctgccgccagaagccaggtgctccctcataagcacagtcagggccccgaaacgagccgcaggcccctgtcccttgtcctgtgaggactgctagaggcctgtgtttcctttgtagtgaaagcaacagccagtggggtggcggcccataacttacacagccccattagggccgcagctgaggggcctctgcgcctggccaggtaggtgggcaggcagcggtccccaagcacagatgaggatgcaggtccacagccgtcccctccctgaccccacccgtgtcagggtggatcccgcagggtcacagggagcctctagaagctgtgagggagggttgtgtttctggaaggggccccttctccagcacctaccccatcttccacagggttcttcgagatgaagatgaagtatgacgaaagcgacaacgcgttcatccgggcatcccgggcccttacggacaaggtcaccgacttgctgggtgagtgagtcatccctggacctcgcaggctggtggtggggcggggtcccggccttccccccgaactcccggctctgctccctgcagggggcctgttctccaagacagagatgtcggaggtgctcacggagatcctccgggtggacccggcctttgacaaggaccggtttctgaaacagtgcgagaacgacatcatccccaatgtcctggaggtgggtgccacacccccaggacccctcccaggcggcaggtcctggctccaccacctcccccgccgcagccggcaccctgggtgctgccagggaactctgctgccgaggctgttttctgaggaggctggttgcacacgggctcctgcccggctgcagctgccccatgagctgtgcccgaagcccttcctgggccttaccggcacctccggtacctccaggtctgtttccctcactcctcctgcctgaggctgttgttcctttgaggttgctgggagcagctgctggaggctagggattgtctcaggtgcctggagcccctcaccccttgggagaagtgggcgtctgtcttcagacatcagagctggccccaggcaacgtctgacccagagctgcagccgtgaggttccctcacggtgctgtccctggcaaccagacccttgttgggcttatagatgagggtatcttgctcaaggtcatgctgcagcctgccccctataagcctctccctgaggttggtggcctcttgtcttccctgctgcctctgcctctctgcagcccccaggatgcaggaggagcctggacaccttcggcccagtcggcagggcctctggaaggccttcatgggactctccatccttggccccgccggcctccgcccaacgtcctcttcctcctccagtttcccgtatccttcccgccacttcgggcagggctgggaggtggtgcggatgggcgccatgcccaaaacagcagcctgagcaccgcagtgccttccgggatgggtgatgggtgccaagtgttctggccacccgccccctgccgctcacagctttcaccaccagcatccggctccttcccgctcttctccccgctccaggcacctccctccccctcatcggatccggcccaggctccaggatcctgtggaagcagctcccagcccaggcacgccccctgcagcccacccctccctctcgctgcccccagcagttaggaggcagccggtcccatggtgggccttgcagtccgaaatgtggtcccctggggggacagaggacatgggctcactgcgggagccggagttgggtcctcatctccctggcttggattcctgaccaggctgaaagctgggtccccagccacctttctcttcctccaccaggttccaggggggtcccctgtggggtgcctcctgggtggtcgcccgcaggccgccctccgcctgtgcctaggccagagccaggcactgacaccagcagggacgggcctgggggggacacccagtgccacagctccacccgcgccccacaggtggcagccgggggtgtctgaggaaactccccaccccgcaccactggagaatgttcccaggacctcgcctgctgcctgaaaagcccactctcgttctggtgcttattttcccttcctttttaggccatgatttctggagagcttgacattctcaaagactggtgctatgaagctgtgagtacttcctttctttttctttttttttttttaaggcctaaaaaatcaccatggagaagttccacttcggtggctccgttggggtagctcccaacaggcaggacctgggctcccggtgggggaatcctcacgtctcaccctccgagagcctgacatccccccctgcccctttccattcctcagcatgtgacacatctgggctctcaggctggacaccgggtcacccgccagtcctttgctcccagactgtaaactttgttagggagaatccttctctgggctggtgtctaagagatggctggttgggggtgtcccctgggcctgtgagagatcacaaagctgccaattttactgggccttttttttccctccaatcttaaaataattttggttaggtctgggcacggtggcctatgctttcaatcccagcagcccaaggcgggagattgcttgagcccaagcattcaagactagcctgggaaacatagcaagatcccgtctctacaaaaacatttaaaatgagccaagtggcagggtgcggtggctcatgcctgtaatcccagcactttgggatgccaaggcaggcgattgcctgagctcaagagttcgagaccagcctgggcaacatggtgaaaccccatctctactaaaataaaaagttagccaggcatgctggtgcatgtctgtaatcccagctactggggaggctgaggcagtagaattgcttaaatccgggaggtggaggttacagtgagctgaggtcgcgccactgcacttcagcctgggcaacagagcaagattctgtctccaaaaaaaaaaaaaaaaaaaaagagccaagcatggaggcaggcacctgttgtcccagctattagggaggctgaggtgggaggatcacttgagctcacgaggtcaaggctgcagtgagtcatcgcagcacagcactccagcctgggtgacagatcaagacactgtcactaaggaaataggtcgggcacggtggctcacgcctgtcatcccagcaccttgggaggctgaggcgggcggatcacctgaggtcaggagttcgagaccagtctggccaacatggtgaaaccctgtctctactaaaaatacaaaaattagccaggcctggtggtgggcgcctgtaatcccagctactcgggaggctgaggcaggagaatcgctagaacccaggaggcggaggctgcagtgagccgagattgcaccactgcactccagcctgggcaacagagcgagactgtcttaaaaaaaaagaaataataatttagggaaggagagtcccaggagaggtggttgcagccatgaagtaaaatgaggtgtctgggggccgactgccctatttcaggtggctgcagtggcctggggtgcaggctggggccgggggtcagggacagtgtgggtctcccacatgactgggggggggctgggagtcaagtggggtttgaaggtgtcacccatcccacttcccaggccagagcagagtccctgtgctcacctcccacgggtcgtgagaatgaagtgtgatcacagaaaccagggcagtgctggccccgggccagagggaacccacagaggtaaccctggtaaccaaacagcccctggaagagttgggggagctttcatcggtgacccggggccgccacctatggggcacggatggggttgcggcagtgggtgcccctccccaggccctgggagcctctagctgtcctcacgacatgatcctgaaacatagatccaaacaaaacatcgatagtcttcccacaccaggaaggagctgtgtcctgatgaggcctcagctgcttctcagagtcaaagcttggggttcgggggccaccagcagcaccgcgtacctggggtctggtctagctgtctgccccatccctggcagcctccctgtccctgcccgagtccatccctgtggggctcccagctctcatctcctcaggccacctcatctcaccctattcgctccccgacctgtgtgtttctttcccctggcttcttcgtattaagcgatccagaatcgttcttggctaattctattctgcacccagctcataaacaacttggaaaaagcagaggagaagatgtcagattttctttttaaatactcccctgcatggtgactaatccagcaggcatttatgagtttcgatgtggattttttttttttttttttttttttttggttttttgttttgtttttaccttgggaccattacgccacagctgactcgctttgccagggagctgctggtgccctggaaacacagctgaagttccagccacgtccacagaagtgtttttaaaatgtcacctttaagaaaccgaacaagtaggattggctctgttttttttttctctcccctccgcggatcagtcatttccataaaaagtagatgctatcagaacatcttttctctcatggtttcatgccaagcccagagaaacctccagcgaaaacgtgtctcgggggctgcttcctgtgcctggcacaggcgcagggggttgagggtgacactgggggctggtcagtgacagaggcagcctcaggctgaggacagatcctagaagaggcgtttgatctcaggccaagattcagagtgcggcgaatatggaagtattaaagatcagccaaggggccgccagcttagccctgggagtagatttgggattttgttccaagagaatcacccactttgctgattaatcctgttttcattgggtcatctggatagagtgttgttcccaggagtgggaagcgtgtgatctgggccagtaagtgggtggcacctgcctccccacttggacctgggttcttggcctctgccattgctggctggcggcagggcacctgggcgccagggtgtgtgggcagcagctctgtgtggcgtggtgccaccctgggtggcatcacgcaggcgtgtcggcctctcattgcagacttacagccagctggcccaccccatccagcaggccaaggcactgggtctccagttccattctcgcatcctagacattgacaacgtcgacgtaagcacctcgcagtgggggcccgggccaccatcgggggtgggaactatggcccagacaaggcccaggaggtggccttgccaggggctgggggccatgggctgatccaagaggtcttgggcttgtccaaggggagggtctcgagggaggcctggtcctggcctgagagcaaggccacggggagggaccggtgctgggcctggtgctggagccttctcctagcagggcctaggcgcaggggtttcacctccaggggagcagccgggctgtcctctgaggcacatcccccctctcggcccctctgcagctggccatgggcaagatgatggagcaggggccggtgctgatcatcaccttccaggcacagctggtgatggtggtcaggaaccccaaaggcgaggtggtggagggtgacccggtgagtgagggagtgggatggggcaggcacatgacaccgcctgtccccaagatctgtgtgtggccacctggcagagaccccagctcagagccctgaagctctgggactgggtggggatgtggagaaacctctgggccagagtttggggttgagggaggtcggagaccagcagacctgtctgtttttaccaaggctgagtggttcctgagtctaggcaattgtgctggcctctgctcccagcccctggggaagttgccggtggctcctgccccacagagcctggcccccccccagagctgcctgggtcacctcaaccctctcaacagtgcccttcccaccccaccctgcaggacaaggtgctgcggatgctgtacgtgtgggcgctctgccgagaccaggacgagctcaacccctacgcgggctggcggctcctggacatctcggcctccagcaccgagcagattctctgagtgtggtgccggagccaggtagccccggcctgggtcatcaggcacagaggcaccgcaacactcactgcggcaactccagacctctgggaacaagactgtcgctctgcccccagctctgccaggacggctgcaagaccagctggcccgggaggggacaacgggctgttgcgggtgcccggcagctggagacactcccccgcagggccaacccctgccctgttgctctgcctgcaggggtcccggcgcctggtcacctggggtgcacacaggtcacacagtgccaagagccccagggcccagggactccccccacagcagggtgggacccgggacccgcggctcagtggcccgctagccacgtcagccaagccactttaggtccattttttaattttaacagtgctcttccatcttgtgcataagcctgagatttggaaagaataaaacaccgaattgcagaagagca

SEQ ID NO: 13017 - DNA, 104 bp, Homo sapiens
ccagcactttgggaggccgaggcgggtggatcacttgaggtcagaagtttgagaccagcctggccaacgtggtaaaaccctgtctctactgaaaatacaaaaat

SEQ ID NO: 13018 - DNA, 767 bp, Homo sapiens
ctgagatggagaacacaagtctatccatcgcagaagccaggaatgcatgctctccggggccaagctgcctccctttgaaataatgaagtcccataaacccatatcacaggttagtaatgcaaaaagaccgggtgcggtactcacgcctgtaatcccagtgactcagaggctgaggcaggaggatcgcttgagcttgggaattggaggctgcagtgagctagattacgacactgcactctagcctgggtgacagagcaagcctctggctctataaaaaaaaaaaaggatccaataagacaaacagcaacagcaacatacattagctctcccaggggaccaaccctcctcctcatacccggattgcatggccatgttaaaataccgccacctggtggcggcattcttcgaatggaaaatagcatctggggtgctgaaatgacaaaggcctgagcgtcttcagatcagagtgtcagttcacactgaatcgaagtaggactggaccacagtcagcccgctctcagcttcctcttcttattcggggtcaaaaccaacaggcgtcttcccaaagcgccgcacaagagtgggctccttcgctttctcggagcgactcacttgctggtctctcagccattgtcaatcaatcagtcattgcaggggcagccatagacaattactctggagctggtccgccggtcaatcagaatccaatcgaatccgtccttgtggtcggtggatccacgtgcctgtaccacctgccaccagcgccc

SEQ ID NO: 13019 - DNA, 6961 bp, Homo sapiens
agaagaggtgttcctcaaatttgtgatattgcatgcagaagatgacacagatgaagccctcagagtccagaatctgctacaagatgactttggtatcaaacccggaataatctttgctgagatgccatgtggcagacagcatttacagaatttagatgatgctgtaaatgggtctgcatggacaatcttattactgactgaaaactttttaagagatacttggtgtaatttccagttctatacgtccctaatgaactccgttaacaggcagcataaatacaactctgttatacccatgcggcccctgaacaatccccttccccgagaaaggactccctttgccctccaaaccatcaatgccttagaggaagaaagtcgtggatttcctacacaagtagaaagaatttttcaggagtctgtgtataagacacaacaaactatatggaaagagacaagaaatatggtacaaagacaatttattgcctgagatgaaacatataacatgtggctggctcttgttttgtaaaccaaatgattaatcttcacttgagaaagcagtttctaggaaatgtttaaataaaagagagtcttcaccttaaagaaacctatggagcacaagaaagataaatttctgcaggacagcctataaaattgtggtactttttgatgtttcagtaaacttgacattgtcagagtttcaaggacttttctttcacaattttcctagttcatggatatgaaaaaggaattctcaatccatattccttgtattgaaccttgaacaaaaacttgtatgacagacatttttaaaaatgtgacaacacttttattctctgaattttgatctcaaaggacacagaaaaaaaatggccccaggagatctgatcacacttcctcctgaggcacctctcatggatgttgcaataagcattcgggtactatcacccagaaatatgaattgccagaatagaacatttagcatgttaagcgttgatgcatataaaatcagaaatagatgtgagaatggtggaactttttaaaagaacccagtcaaatgtattttctgctgaaatctgcatatttggaggcatttcccaccaccgattcacagcccatttgatagtgtggtagttagggacttcgtggagtggtgttcagacgtcccctggggcttaaatctcttcatattagtcatcatttgtaactatggctttatttgcagagcttctaaaaggcgtataactgtgtgagtggccagatattcactttttaaatcaaaaacctctcttatggaagctttaaaagtttccgtcacacacaattctcttctcaggaagtatttctcatttaggtcttcaaagtagcctgactgtgtgcatgtgtgtgtgtgataggttatttataaagactttggatagaaggagatgtattttattacctcctattctagagccccatgctcctaacaagccagagaggccccaaacaggattgtttctttcctccacagcccttctgcccatctgagattgagggagcatcgtccacttgagatcagggatggggtggagaatgggtcatgtcatgtaatgagaaaagccctcttcgggatcatgagacttggttctagtccaatttctgccactgaggatgaatgtaactgtgggcaaactatttaccctcctttatctgtgaaatgaaagggttgaattgatggatctctaaaggcttttgtcctctatgaggatgtgaaaaactagggaccacaaaagggaacaagcaaaaaagtttggattcgataaagtgatatgtaatagttgcagaaggctttatatatgcttataatgaaaagatattttttgtatattgacagcataatttatttttaatgctgtcattacacttaaagtcacaggaaaaaaatatacatgcttactcaggctttcttaaaaataaatttttatagagatccttgagtaaagacattttgcttaatttcttttttcttattccccacttgtatatcccctaccagtaccgggatctgcacacatctttttgcagttacctcttcatagccatgaaccaaaacgttctatgaggagcatgcaagtaagtcaagcctcctattctgttagtacttattagaggaggagatggttttcattgcatagtgacattttcttagccttaacgttctgatagtagcttactactcacttctctttttcagttttcataataagtattcatttttttgccataatgcttcctgtaaagccaattttatatactaataaaacatgaactgcccactcttcatgcctgccaaacttggggcaattgatgctaaatggtatttttaaaataaatgtttttattctttactcttgactaaacttgtttattttcaactccaatgaagattgtggaagagtgttttgaaatgaagcatcgatttgtacttcatagagcaccagacacaatgtctcacccaatttggagttccatattttttttatgataaagaaaaatgttggccgggcgcggtggctcacgcctgtaatcccagcactttgggaggccgaggcgggcggatcacgaggtcaggagatcgagaccatcccggctaaaaacggtgaaaccccgtctctactaaaaatacaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaatgttaagtgctgaattattatatatgttgaaattatcaattgtaacaaaatagctaaactgaggatgaaaacaggtaaaggtgtgggctttgtcatgtttgttgtgtacatatgtgcgtgtgcacacacccatacacacatgtacatatctaggtacatacacatatcaggaaatatgggaaattttgcactatgctggggagctttcattttgagtactctgtgggccttattgcccaccctggagctttacaggggagaacccgagttgagcctcatgtatcagttaggaaaaccccacgccacgtggcctaaaccataagaaaaaaatattatccgacttaacaagaggtccgccaaggtacaggggctcaaatgtgtcattaaaatcccagtcatatactgaaatattattcagttctaaaaaggaatgaaattctgatacataccataacatgggtgaaccttgaaaacattatgctaagtaaaataagccagatacaaaaggacaaatattataggattccacttatataaggtaaattcacagagacagaaagaatagaggttaccaggggctgagggcagggaggaatatggagctattgtttaatgggtacagagtttctgtttggggttgttgaaaacgttctggaaatgggtaatggtgatgacacacaacattgcgaaatgtacttaataccactgaattgtacacttaaatatggctaaaatgatagattttatgttatatatattttaccacaatacaagttgaatatcccttatccaaaatgcttgggaccagaagtgttttggattttggattttcatattagagatgctcaacttgtaattaaaaaaaaaaagaaaaggtaaaaaaacaaacccaggttctttccatctttttgctcttccattctcagtgtttcggttgagctcccttccaaggtgtagcctggctgctccagtgtccgacactgtatacagacatgacagtgtccagcctaataagatgataggagtggtccacccatatggaaaaaataattcatcactgcattattgaaaattgttgatacccagtaatgataaagagccatctgactcccagctggttccattatttcaaaattctccctacccctaccctgagtggacacctcctagcctccctgcatccaaacatcttccaacaccgtttctgagtcagactacctggatttgaattccacctctgtcctctgtaagtgatgttcttaaaaagacacttaatttttttgagttttaatgtcctcatctaaaaataaagatcataaatacctccctgaaaggtcattttgaggatttaatgagctagtgcctcacatatagctaccatatctatgctactagaactattttttgttgcctacacacattcaatatgcagcatgggttggcgggcaggacacatatgcatttttacatacccacaatcctatccttggaaacctcgcaacttgtagggaatagattttaaacaaagacaaaggaagatgccaggccttgttcccatgtgcagtacagcccccagtcaggcactgaaaagcagaggagcccccttgatcagcaagagatgtgtgagctgttaatgatgagtatgagtgcggaggaagctggtggcatgaaggatgcaagagcatggtgccatgattctaacaagtagaaagttgagccataaactagaaaagcaggaaaatggagtctaggagtgccagctttgaagtcagttaggaggaagaatggctcagacctggatgccttcagtggagttttgttgctccttacacttaaaaatggtggatcaactttgtgttcatttgattatggagggcagagggtgtaatccgtttaatttagctcttttctggggcttagcaactcccagataattttgcctcatttgggaataggctgtatgagtttagttatactattccccttgggttgggtggagaagggagtaagagtatcactagtctactctgctcctttctttcctgactaacttaagttctgccttgaattcaacaagctgtttgctggggttaacgctttccagcacaagtcagggatgttttccgcttcagtccctcatccttcaattttgcagatcctaatgcattggttgtcaaaaccacttcactgcatagaaggtaacaccactagtaacagaaataacttcccttggccctctcatttgcaacagctcattcctaaggcccaatcccagttcctgatggtggatgttgttccagcctggaaagctgaatcacttcctctccagtaacgaataaatagactagatttcactgagtcatctgtctgcccagcaaaggaccctgcaaaaaagagatcaaagtggttttcacagtcttgttgcaaaggaaatctgagttggggcccaagtattcaaagggtgtagagtggctcaatattagtatctaattcaggagaatcatttcagtgcaggcaaaggatttcaggtcctttatctgtacattttgcaggtaaaaaacctcagtgcaggtaaagaaaccacatgccatgctgtggagtcaggctattcccaactgtagagaaagtccattgatccatgagtgtggtggggctggccccagggctagtgagaagctgttgccatggctgcattgctggtaaggtgggattccgtgtgtttgccctgagcaatctgcgctgcctctgtgactttcctcctcttctcagtcttacaccgcctggtcttaggtcatctgctaagctgtcacagaaagtgacgtaccctccacacctgtggatggtctgaagggcaaggaggaaatttcagaaagctgtcaggcacttgatgaaatgaaaccacagcatctggaagttgatgtccttaagccaatgaccagaaggaatgaaccagagaactgatgttgttgtccatggacctgatgtttcttatgagattccaagtagaaaaatttattagattttgaacacttaacggctggataaggacaactttcttatatatatatatatatatatatatatatatatatatatatatatatatatatatgtcatatgtggcaatactcttgtcaattaacatattaagtttggattgaggtaagtaatacttgaaagtgccattaattaataactcagagcatgaaaattatttgattaaaagctcaatgaggctgggtgtggtggctcatgcctgtaatcccagcactttgggaggccaaggtgggtggatcacgaggtcagtagttcaagaccagcctggccaagacggtgaaaccccatctctactgaaaatacaaaaattagtcaggcgtggtggcaggtgcttgtaatcccagctactcaggagactgaggcaggagaattgcttgaacctgggcagcaggggtcgcagtgagcctagatctggccactgcactccagcctaggcgatacagtgagactctgtctcaaaaaaaaaaaaaaaaaaaagctcaacgaattaacttgtggaaaaaaagaaagacaattgctcttctctcttctcctttgccaatgaacctgctctcacaactgtttactccaacatctatactccttcacagttgccttcctttctgtcatgagcaagaattgttctggggaaatcacttctttagttagtttaacacacttctatttctcttcagatagagtgagttctgagtcattttcactctgaggtgaataattagaaatgcttttattagcaagtaacaggaacctgcatttaagcagtttccaaatctaattagaaatgttgctttcagctacctactcaaactacaggtttaaatcaagaaaattgtttttttctattatttgtaggggacctctacaaactagctccttccggaggttttccatgtatatattggacaggacacataacaagctttacagatttctgtatattttatgtgtatttataaataatgctatcacattaaaatgttctaaaattagattgcagtgctggttgcacaactctgcacatatactaaaaactgttgagttgtatacttgaaatgggtaaattt

SEQ ID NO: 13020 - DNA, 6941 bp, Homo sapiens
agaagaggtgttcctcaaatttgtgatattgcatgcagaagatgacacagatgaagccctcagagtccagaatctgctacaagatgactttggtatcaaacccggaataatctttgctgagatgccatgtggcagacagcatttacagaatttagatgatgctgtaaatgggtctgcatggacaatcttattactgactgaaaactttttaagagatacttggtgtaatttccagttctatacgtccctaatgaactccgttaacaggcagcataaatacaactctgttatacccatgcggcccctgaacaatccccttccccgagaaaggactccctttgccctccaaaccatcaatgccttagaggaagaaagtcgtggatttcctacacaagtagaaagaatttttcaggagtctgtgtataagacacaacaaactatatggaaagagacaagaaatatggtacaaagacaatttattgcctgagatgaaacatataacatgtggctggctcttgttttgtaaaccaaatgattaatcttcacttgagaaagcagtttctaggaaatgtttaaataaaagagagtcttcaccttaaagaaacctatggagcacaagaaagataaatttctgcaggacagtctataaaattgtggtactttttgatgtttcagtaaacttgacattgtcagagtttcaaggacttttctttcacaattttcctagttcatggatatgaaaaaggaattctcaatccatattccttgtattgaaccttgaacaaaaacttgtatgacagacatttttaaaaatgtgacaacacttttattctctgaattttgatctcaaaggacacagaaaaaaaatggccccaggagatctgatcacacttcctcctgaggcacctctcatggatgttgcaataagcattcgggtactatcacccagaaatatgaattgccagaatagaacatttagcatgttaagcgttgatgcatataaaatcagaaatagatgtgagaatggtggaactttttaaaagaacccagtcaaatgtattttctgctgaaatctgcatatttggaggcatttcccaccaccgattcacagcccatttgatagtgtggtagttagggacttcgtggagtggtgttcagacgtcccctggggcttaaatctcttcatattagtcatcatttgtaactatggctttatttgcagagcttctaaaaggcgtataactgtgtgagtggccagatattcactttttaaatcaaaaacctctcttatggaagctttaaaagtttccgtcacacacaattctcttctcaggaagtatttctcatttaggtcttcaaagtagcctgactgtgtgcatgtgtgtgtgtgataggttatttataaagactttggatagaaggagatgtattttattacctcctattctagagccccatgctcctaacaagccagagaggccccaaacaggattgtttctttcctccacagcccttctgcccatctgagattgagggagcatcgtccacttgagatcagggatggggtggagaatgggtcatgtcatgtaatgagaaaagccctcttcgggatcatgagacttggttctagtccaatttctgccactgaggatgaatgtaactgtgggcaaactatttaccctcctttatctgtgaaatgaaagggttgaattgatggatctctaaaggcttttgtcctctatgaggatgtgaaaaactagggaccacaaaagggaacaagcaaaaaagtttggattcgataaagtgatatgtaatagttgcagaaggctttatatatgcttataatgaaaagatattttttgtatattgacagcataatttatttttaatgctgtcattacacttaaagtcacaggaaaaaaatatacatgcttactcaggctttcttaaaaataaatttttatagagatccttgagtaaagacattttgcttaatttcttttttcttattccccacttgtatatcccctaccagtaccgggatctgcacacatctttttgcagttacctcttcatagccatgaaccaaaacgttctatgaggagcatgcaagtaagtcaagcctcctattctgttagtacttattagaggaggagatggttttcattgcatagtgacattttcttagccttaacgttctgatagtagcttactactcacttctctttttcagttttcataataagtattcattttttttgccataatgcttcctgtaaagccaattttatatactaataaaacatgaactgcccactcttcatgcctgccaaacttggggcaattgatgctaaatggtatttttaaaataaatgtttttattctttactcttgactaaacttgtttattttcaactccaatgaagattgtggaagagtgttttgaaatgaagcatcgatttgtacttcatagagcaccagacacaatgtctcacccaatttggagttccatattttttttatgataaagaaaaatgttggccgggcgcggtggctcacgcctgtaatcccagcactttgggaggccgaggcgggcggatcacgaggtcaggagatcgagaccatcccggctaaaaacggtgaaaccccgtctctactaaaaatacaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaagaaaaatgttaagtgctgaattattatatatgttgaaattatcaattgtaacaaaatagctaaactgaggatgaaaacaggtaaaggtgtgggctttgtcatgtttgttgtgtacatatgtgcgtgtgcacacacccatacacacatgtacatatctaggtacatacacatatcaggaaatatgggaaattttgcactatgctggggagctttcattttgagtactctgtgggccttattgcccaccctggagctttacaggggagaacccgagttgagcctcatgtatcagttaggaaaaccccacgccacgtggcctaaaccataagaaaaaaatattatccgacttaacaagaggtccgccaaggtacaggggctcaaatgtgtcattaaaatcccagtcatatactgaaatattattcagttctaaaaaggaatgaaattctgatacataccataacatgggtgaaccttgaaaacattatgctaagtaaaataagccagatacaaaaggacaaatattataggattccatttatataaggtaaattcacagagacagaaagaatagaggttaccaggggctgagggcagggaggaatatggagctattgtttaatgggtacagagtttctgtttggggttgttgaaaacgttctggaaatgggtaatggtgatgacacacaacattgcgaaatgtacttaataccactgaattgtacacttaaatatggctaaaatgatagattttatgttatatatattttaccacaatacaagttgaatatcccttatccaaaatgcttgggaccagaagtgttttggattttggattttcatattagagatgctcaacttgtaattaaaaaaaaaagaaaaggtaaaaaaacaaacccaggttctttccatctttttgctcttccattctcagtgtttcggttgagctcccttccaaggtgtagcctggctgctccagtgtccgacactgtatacagacatgacagtgtccagcctaataagatgataggagtggtccacccatatggaaaaaataattcatcactgcattattgaaaattgttgatacccagtaatgataaagagccatctgactcccagctggttccattatttcaaaattctccctacccctaccctgagtggacacctcctagcctccctgcatccaaacatcttccaacaccgtttctgagtcagactacctggatttgaattccacctctgtcctctataagtgatgttcttaaaaagacacttaatttttttgagttttaatgtcctcatctaaaaataaagatcataaatacctccctgaaaggtcattttgaggatttaatgagctagtgcctcacatatagctaccatatctatgctactagaactattttttgttgcctacacacattcaatatgcagcatgggttggcgggcaggacacatatgcatttttacatacccacaatcctatccttggaaacctcgcaacttgtagggaatagattttaaacaaagacaaaggaagatgccaggccttgttcccatgtgcagtacagcccccagtcaggcactgaaaagcagaggagcccccttgatcagcaagagatgtgtgagctgttaatgatgagtatgagtgcggaggaagctggtggcatgaaggatgcaagagcatggtgccatgattctaacaagtagaaagttgagccataaactagaaaagcaggaaaatggagtctaggagtgccagctttgaagtcagttaggaggaagaatggctcagacctggatgccttcagtggagttttgttgctccttacacttaaaaatggtggatcaactttgtgttcatttgattttggagggcagagggtgtaatccgtttaatttagctctttcctggggcttagcaactcccagataattttgcctcatttgggaataggctgtatgagtttagttatactgttccccttgggttgggtggagaagggagtaagagtatcactagtctactctgctcctttctttcctgactaacttaagttctgccttgaattcaacaagctgtttgctggggttaacgctttccagcacaagtcagggatgttttccgcttcagtccctcatccttcaattttgcagatcctaatgcattggttgtcaaaaccacttcactgcatagaaggtaacaccactagtaacagaaataacttcccttggccctctcatttgcaacagctcattcctaaggcccaatcccagttcctgatggtggatgttgttccagcctggaaagcttaatcacttcctctccggtaacgaataaatagactagatttcactgagtcatctgtctgcccagcaaaggaccctgcaaaaaagagatcaaagtggttttcacagtcttgttgcaaaggaaatctgagttggggcccaagtattcaaagggtgtagagtggctcaatattagtatctaattcaggagaatcatttcagtgcaggcaaaggatctcaggtcctttatctgtacattttgcaggtaaaaaacctcagtgcaggtaaagaaaccacatgccatgctgtggagtcaggctattcccaactgtagagaaagtccattgatccatgagtgtggtggggctggccccagggctagtgagaagctgttgccatggctgcattgctggtaaggtgggattccgtgtgtttgccctgagcaatctgcgctgcctctgtgactttcctcctcttctcagtcttacaccgcctggtcttaggtcatctgctaagctgtcacagaaagtgacgtaccctccacacctgtggatggtctgaagggcaaggaggaaatttcagaaagctgtcaggcacttgatgaaatgaaaccacagcatctggaagttgatgtccttaagccaatgaccagaaggaatgaaccagagaactgatgttgttgtccatggacctgatgtttcttatgagattccaagtagaaaaatttattagattttgaacacttaacggctggataaggacaactttcttatatatatatatatatatgtcatatgtggcaatactcttgtcaattaacatattaagtttggattgaggtaagtaatacttgaaagtgccattaattaataactcagagcatgaaaattatttgattaaaagctcaatgaggctgggtgtggtggctcatgcctgtaatcccagcactttgggaggccaaggtgggtggatcacgaggtcagtagttcaagaccagcctggccaagacggtgaaaccccatctctactgaaaatacaaaaattagtcaggcgtggtggcaggtgcttgtaatcccagctactcaggagactgaggcaggagaattgcttgaacctgggcagcaggggtcgcagtgagcctagatccggccactgcactccagcctaggcgatacagtgagactctgtctcaaaaaaaaaaaaaaaaaaaagctcaacgaattaacttgtggaaaaaaagaaagacagttgctcttctctcttctcctttgccaatgaacctgctctcacaactgtttactccaacatctatactccttcacagttgccttcctttctgtcatgagcaagaattgttctggggaaatcacttctttagttagtttaacacacttctatttctcttcagatagagtgagttctgagtcattttcactctgaggtgaataattagaaatgcttttattagcaagtaacaggaacctgcatttaagcagtttccaaatctaattagaaatgttgctttcagctacctactcaaactacaggtttaaatcaagaaaattgtttttttctattatttgtaggggacctctacaaactagctccttccggaggttttccatgtatatattggacaggacacataacaagctttacagatttctgtatattttatgtgtatttataaataatgctatcacattaaaatgttctaaaattagattgcagtgctggttgcacaactctgcacatatactaaaaactgttgagttgtatacttgaaatgggtaaattt

SEQ ID NO: 13021 - DNA, 2860 bp, Homo sapiens
agaagaggtgttcctcaaatttgtgatattgcatgcagaagatgacacagatgaagccctcagagtccagaatctgctacaagatgactttggtatcaaacccggaataatctttgctgagatgccatgtggcagacagcatttacagaatttagatgatgctgtaaatgggtctgcatggacaatcttattactgactgaaaactttttaagagatacttggtgtaatttccagttctatacgtccctaatgaactccgttaacaggcagcataaatacaactctgttatacccatgcggcccctgaacaatccccttccccgagaaaggactccctttgccctccaaaccatcaatgccttagaggaagaaagtcgtggatttcctacacaagtagaaagaatttttcaggagtctgtgtataagacacaacaaactatatggaaagagacaagaaatatggtacaaagacaatttattgcctgagatgaaacatataacatgtggctggctcttgtttttgtaaaccaaatgattaatcttcacttgagaaagcagtttctaggaaatgtttaaataaaagagagtcttcaccttaaagaaacctatggagcacaagaaagataaatttctgcaggacagcctataaaattgtggtactttttgatgtttcagtaaacttgacattgtcagagtttcaaggacttttctttcacaattttcctagttcatggatatgaaaaaggaattctcaatccatattccttgtattgaaccttgaacaaaaacttgtatgacagacatttttaaaaatgtgacaacacttttattctctgaattttgatctcaaaggacacagaaaaaaaatggccccaggagatctgatcacacttcctcctgaggcacctctcatggatgttgcaataagcattcgggtactatcacccagaaatatgaattgccagaatagaacatttagcatgttaagcgttgatgcatataaaatcagaaatagatgtgagaatggtggaactttttaaaagaacccagtcaaatgtattttctgctgaaatctgcatatttggaggcatttcccaccaccgattcacagcccatttgatagtgtggtagttagggacttcgtggagtggtgttcagacgtcccctggggcttaaatctcttcatattagtcatcatttgtaactatggctttatttgcagagcttctaaaaggcgtataactgtgtgagtggccagatattcactttttaaatcaaaaacctctcttatggaagctttaaaagtttccgtcacacacaattctcttctcaggaagtatttctcatttaggtcttcaaagtagcctgactgtgtgcatgtgtgtgtgtgataggttatttataaagactttggatagaaggagatgtattttattacctcctattctagagccccatgctcctaacaagccagagaggccccaaacaggattgtttctttcctccacagcccttctgcccatctgagattgagggagcatcgtccacttgagatcagggatggggtggagaatgggtcatgtcatgtaatgagaaaagccctcttcgggatcatgagacttggttctagtccaatttctgccactgaggatgaatgtaactgtgggcaaactatttaccctcctttatctgtgaaatgaaagggttgaattgatggatctctaaaggcttttgtcctctatgaggatgtgaaaaactagggaccacaaaagggaacaagcaaaaaagtttggattcgataaagtgatatgtaatagttgcagaaggctttatatatgcttataatgaaaagatattttttgtatattgacagcataatttatttttaatgctgtcattacacttaaagtcacaggaaaaaaatatacatgcttactcaggctttcttaaaaataaatttttatagagatccttgagtaaagacattttgcttaatttcttttttcttattccccacttgtatatcccctaccagtaccgggatctgcacacatctttttgcagttacctcttcatagccatgaacctaaacgttctatgaggagcatgcaagtaagtcaagcctcctattctgttagtacttattagaggaggagatggttttcattgcatagtgacattttcttagccttaacgttctgatagtagcttactactcacttctcttgtttcagttttcataataagtattcatttttttgccataatgcttcctgtaaagccaattttatatactaataaaacatgaactgcccactcttcatgcctgccaaacttggggcaattgatgctaaatggtatttttaaaataaatgtttttattctttactcttgactaaacttgtttattttcaactccaatgaagattgtggaagagtgttttgaaatgaagcatcgatttgtacttcatagagcaccagacacaatgtctcacccaatttggagttccatattttttttatgataaagaaaaatgttggccgggcgcggtggctcacgcctgtaatcccagcactttgggaggccgaggcgggcggatcacgaggtcaggagatcgagaccatcccggctaaaaacggtgaaaccccgtctctactaaaaatacaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaattcttctttcagttt

SEQ ID NO: 13022 - DNA, 386 bp, Homo sapiens
ggatggtttaactattgttttctcattcaggggaaacttctttctgcaactttgcatagcaaaaccctttttttttacgatgcagtaacaaaagtcagcagtgaatcctaatcaatgaagagagtccaaattaatttggttttattattttggatggatatatgtcacattttagagttattatgccttagaatacctcttggtaactagcacaatataccgtggagcgagaacctaaagtacagacagagtgaatgacggagtggtcagcagtttcctcactagtcagaggcagctgcaaacatttttactcacatacattgaatgaaattctctgtttttttccttggtttttgttcccatgacagttttcaccacttttgttg

SEQ ID NO: 13023 - DNA, 539 bp, Homo sapiens
acgaatgcagacatttacatacactgtgatttgtgagtttcagggtgggatagatctagcaaaaattatgtttaatgcttagattttatgtaaaactactgtgatattgaatgccgtatgttttgattagagtacagcctgtgcagccccattatttgggttcaattttagttgtacatttatttgttgggtaactttggtcaaatttagttaacctttctatactttcaatttgtaaagtagaaatcataggaatgactacctcagaggtgttctggaaagtaagtgatttaatagagatacagtacttaggacagggggagtaaggcattcttagaagtcgctttcatcctgaccttgcctattattcaaggctgactgctaagagactagttaagcaattagatccagatcttgatagttgccctatttttccccttcaaggccatatgtgttactttcctctaatacatttgcctaaagccaaagaacaatccatctaccacttaagaatacatttattgcttttaacttaaaaa

SEQ ID NO: 13024 - DNA, 539 bp, Homo sapiens; identical to SEQ ID NO: 13023

SEQ ID NO: 13025 - DNA, 402 bp, Homo sapiens
ggatggtttaactattgttttctcattcaggggaaacttctttctgcaactttgcatagcaaaaccctttttttttacaatgcagtaacaaaagtcagcagtgaatcctaatcaatgaagagagtccaaattaatttggttttattattttggatggatatatgtcacattttagagttattatgccttagaatacctcttggtaactagcacaatataccgtggagcgagaacctaaagtacagacagagtgaatgacggagtggtcagcagtttcctcactagtcagaggcagctgcaaacatttttactcacatacattgaatgaaattctctatgtttttttccttggtttttgttcccatgacagttttcaccacttttgttgaacagtttcttcta

SEQ ID NO: 13026 - DNA, 365 bp, Homo sapiens
ttagtagaaacaggttttaccatgttggtcaggctggtctctaactactgacctcatgatccgcccgcctcggcctcccaaagtgctgggattacaggcgtaagccaccacgcctggcctgagatgtgatttttaaaaaacttttacagtgaaaacttccatatatattcaaaagtattgagaaaagtacaatgaacccccaccatgtcaacaaagattaacacatggctaatcttgcttcatctacattccccgattatttttaaagcaaatctcagatattttatcacttcagctacaaatacttttatactttatttctaaaagataacactttttaaaaacataaccccaatagtattata

SEQ ID NO: 13027 - DNA, 3903 bp, Homo sapiens
gcctggtccagctatcgtgctcggtattcagttttccggagcagcgctctttctctggcccgcggggcccgcggccgagtaccggattcccgagtttgggaggctctgctttcctccttaggacccactttgccgtcctggggtggctgcagttatgtccgcgctgcgacctctcctgcttctgctgctgcctctgtgtcccggtcctggtcccggacccgggagcgaggcaaaggtcacccggagttgtgcagagacccggcaggtgctgggggcccggggatatagcttaaacctaatccctcccgccctgatctcaggtgaggagaaagaggaagactagagaattgggggtggggggcgggggcggggcctcctcatctcacaataactctcttccttttcagagtgaccgttatactaatcttttcatcccacagtaatgtctgttctcctcctgtaacttccttaccgggatcacaataaccctcctatgcaaagaatagcgctcttactccatccccaccccaggaatcccctcctcctaattaacaccccctatgtgtttctttcttcacagccatgttctcctcgctgtttctattagccccttctatgagaatactttattgctcaccaagtaaccccacccttccaagccccattcttcatcccctagaagctgttctccaagtccctcgaggtctggggtgtggacattggggagggtcaactgaggacactctgaccactgacttggccctcagggcagctgttaaatagatgatcccgtggctaatgggagtgaacttgggatgggtcaggagacaataaggtaggggataggttcaggtaaggaagagggtgcagacaatagaaaagagaccaggcaggtagaagagaaggcatagtccccagagataggcgggaaatggaagggattttaggatatcacttcccaccattccttcacgtctcctctgtccaggtgagcacctccgggtctgtccccaggagtacacctgctgttccagtgagacagagcagaggctgatcagggagactgaggccaccttccgaggcctggtggaggacagcggctcctttctggttcacacactggctgccaggcacagaaaatttgatggtgagacctgggtccccaaactcagcttcacagctcctctcggtgcttaggaccccagcaaggctcctgtccccactccttactccatctgtgaagactccatcccctcccagcccgcccaccccccagactctgtctccaggccctgccctcccccattccctgtctgccccatctctgagagttactcagtttctgattcacttgtcttttctcttctctcccatctcctcctgcctctgcctgttcacttttctccccattctttggcctgacctgccttccacctgttccctgcatttgctgcagagttttttctggagatgctctcagtagcccagcactctctgacccagctcttctcccactcctacggccgcctgtatgcccagcacgccctcatattcaatggcctgttctctcggctgcgagacttctatggggaatctggtgaggggttggatgacaccctggcggatttctgggcacagctcctggagagagtgttcccgctgctgcacccacagtacagcttcccccctgactacctgctctgcctctcacgcttggcctcatctaccgatggctctctgcagccctttggggactcaccccgccgcctccgcctgcaggtgagggatcctgaggcctgagcttcaaccacttctgacctagtgacccctgaactgtgcaccactcacctccaaactggcgtgctccagtcacctctgacctggtgatcccccatcctgcattgaagccatttctgacctggtgatccctatcctgagctttactcaccactgcccgacccagtgccccttggtcttcttgaagcagatgcccccacccctgccacctcccattctgagccctagtttcacacaaacactcacctgcccttagcctccagccacctttgtgccaaccccttcctaatcgtaacaccttgacttcctctggttcaactaaacaggaattgtgcattcaatacgcaaaaggcattttcttttatagtatcacatttagttgtcatcataaccctgtgaggtagacagtcatgcccttattttacagatgagaaaactgaggctcccagagattaagcttttcagccagtaagtggcagagccgtggctcacacccaggtcttctggcttcaagttcagtgttagttccgatacacaatttctctctctctaagccctgtacaacataatccctccatctcttcccaagccttcctttgtttttctttaagactataattcctgtgggggctcttgaacctgcctctctgtaccacccaacactcgacccactctgagagaaccccacacacccaaccctcactgctcttgatgcagtctcttggctccagtcttgactgacccataacaaccttgtggtttttctcaccttctttgccttctcccagataacccggaccctggtggctgcccgagcctttgtgcagggcctggagactggaagaaatgtggtcagcgaagcgcttaaggttggagggtgcctgagtatgggcagggccagggagggagaggtggaagtgagagagaccccacaaggaagaaacagccaccagccagcaggacaggccttgggctctgtctgcctccaggccctggtgtcctaggatgaattaggaaggagggggctggagtgaaacctccaatggtccacgatccatgatctctgaccccctcctcccctctgtggacccataccctcctcagtccccaagggcctgctcatctccatagcagtaggagattggatactgcccccgcccaaccccccaggatccctcaatgactccacttccctgctgctgaaggccagatgcctggcttggcctctctcactgcccatcctctacctgacctcccagcctcaccttctgcctcctgaccgcctcctccctccccagctgtgatgggctcactcttgtccttgaatgttccctccacccctaactgcctctctatttccacccctcccacgaatcagagtcagcaacctggaacctccctcctcagatctgtgacaatctcacctgctgccacgtggggtcaccaaccctaggtgtagggtggggtatgtgatttctgtctgtgcccagcaccaagccaggctgagagcagccacagcgtttgtggaggacacagccccactctctgcccccaggtgccggtgtctgaaggctgcagccaggctctgatgcgtctcatcggctgtcccctgtgccggggggtcccctcacttatgccctgccagggcttctgcctcaacgtggttcgtggctgtctcagcagcaggggactggagcctgactggggcaactatctgggtgaggggattcaagaaagcctggagccaggcatggtggctcacacctgtaatcacagcactttgagaggctgaggcaggaggatcacttgaggccaggagttggagcccagctggggcaacatagctagacgtcatctcaagaaagaaagagagagagagaaagaaagagagagagagagacagagaaagaaagaaggaaagaaggaaggaaagaaagaaaaagaaagaaagaaagaaagaaaagaaagaaatcagccaggcatggtagcgcccgcgcctgtagtcccagttactcctgaggctgaggcaggaggatcacttgaggccaggagttggaggccagcctgggcaacgtagctagaccgcatctctaccaaaaaaaaaaa

SEQ ID NO: 13028 - DNA, 101 bp, Homo sapiens
aggagttcgagaccagcctggctaacatggtgaaaccccatctctactaaaaatacaaaaattagccaggcgtggtggcatgcacctgtagtcccagctac

SEQ ID NO: 13029 - DNA, 5091 bp, Homo sapiens
tgctctctcattcaaggttacccttctatcactccaaggattcaccccataaccttatctttcttgacatgttacactcactaaaatgttcacgtcaaatcaagtttgtagacacttgtccttaccaccttacaaaaagtgagatggtatcaacagaggtgagacactgctttacctgcatgtcacttttggcggctttcacagcattgaaaagatcattggctggtggctctgactgtttccggctatgacgatgtaccactcgggaccctttctttggatgttttgccacctaatatgtataaaaagatcagaaatatgaaaaaaaaacaaaaaaggtaacagtgacattaacgcttggtttcatcattatcacacaagtaggcttaagctgccaattccacagcagagtctgagttagactcagtcctgaaataattgatttttatattgttatgaagtttatttttttcccttaaaaaaaaagtccttgagtccccttcctgtatctctacatcctaacgtccttttctcttcttttctcttcaaaatttctcttcttcctatttccatcccttaatactttgtaaatcttgtccttttatgaaccgtatcacctgaacctcttttaggttttcttttctttttttttttttgagacggagtctcgctctgtcgcccaggctagagtgcaggggcgcaatctcggctcactgcaagctctgccccctgggttcacgccattctcctgcctcagcctcccaagtagctgggctgcttcccccacaagattcaaaaacaaaagaaaactggctgactcaccggtgttgttttcggtggtcgttttgctgctctcttcttcacattgcgattcaagctgtcttcaaagtcagtgtcttcatcagctaacaaagagtcgccattcctgtgagaaagtatggttctctttaaatataaccaccctattccctccatataaaaggctaattaattatggtttctctgtctctcaccgcaccccatctccatgagaaaaacatatccagattttaagaaaaaatgagcttattgttagtaggaagttgggacaaagtcttttttttttttttttttgagacggagtttcacccttgtcacccaggctggagtgcaatcgcatgatctcagctcactgcaacctccgcctcccaggttcaagcgattctcctacctcagcctcccgagtagctgggattacaggtgtttcaccgtgttggccaaggtggtctcaaactcctgacttcaggtgatccacccgcctcggcctcccaaagtgttgggattataggcatgagccaccacacccggccgggacaaagccttaaaggaaaactttcacatgaaagcaatggagatgaagaatgaggaaatgaggcaggagaaggacaactcttcctagtattctctccgaagaagagaatcaaatgatactcacttagcaggtagcgagatcactgctctttgtagagaaagataatcatggctcaggaagtcatctatcattcatccataaatgggagagtaatatgtatctagagttaaatttcacccccttgaaacataaaccacatgtcttatcaattcaagtttataactttgatataatctggtcccccacagcagcactgacagaaacagaaatgattcagagaaagccaattaaaacagccaggggataaagcagatctgtatgaaattcgcttttttccttctggaaaggtaaaaaaccaagatatattattataacctacacagaataaactcatatatggtaataaataaggatacacagacctatttacaaaatccccaagtagaagaaataggggacactagccaaaaagtatatacaatttaccaggcaacaaataaagaactctttactcccccatctgccagctctcagcccccaccagggttggtacatgctgaacatagaaatgtgtttaagagaggtttagacaagatggatgatggattaaaaacaggatgtgcttgaacccaggaggcggaggttgcagtaagccgagatcgcgccactgcactccagcctgggcgacagggcgagactccgtctcaaaaaaaaaaaaaaaaacaggatgtactactattttgatgtctacaacatctaggaccgccaaaaaaaacacctggagctggagggagggtgtcactgtgctgaacgagtatagcacttctggtgttttcacacagtcccacgcatattatcatcaatgtgggaaaacgagggggaaggctgccagggacacaggaagtggccacacaatgcaacatctacttacccctctgaggtatggtttgagtccctgtcatcaaagggtagactggcagaggaactagaagatgcagacaaggccctcttggtatctcccacagctctttgcaacggggaagacatgcttggagaggaggagctatgaggccaggaagatgaggaccacagggtaggtatggcgatccagctggggaagaaagagaagaaagggctcctaccacagcacttctccatccccagccctgaccagtccctttctttccaagggaatggttctagaactctggggtcaggtgagggggaccaaaaactaagacaaaggctgggcaccgtggctcatgcctataatcccagcactttgggaggccaaggcaggaggatggcttgagcccaggagttcaagaccagcctgggcaatacagcaagaccccatttctaaaaaaaaaataataataatcattagtcaggtgtggtagagcatgcctgtattcagctattcaggaggctgaggtgggaggattgcttgagtccaggagttcaaggctgcagtgagctacgatcgcaccactgtactccatccagcttgggtgacagaagaagaccctgtcccccctcaaaaaaatagtaatgataaataagacaaatggctgggcacagtgactcatgcctgtaatcccagcactttgggaggtcgaggcaggcagatcacctgaggtcaggggttcgagaccagcctgaccaacatggagaaaccccatttctactaaaaatacaaaattatccgggtgtggtggcatatgcctgtaattccagctacttgggaggctgaggcaggagaatcgcttgaacctagaaggcggaggttgtggtgagctgagatcgtgccactgcactccagcctgggcaacaagagtgaaactccatctcaaaataaataaataaataagacaaagagctgacctaaggcatcaagggattaagcacaacaacaccccagaaactggccagcaggtttggagttgctctccaaaagctgaggaagtcacacaccagggtagcttcagacacatctctctctagaggctgtggaagtgcaaactgcctactgcaaggaaatttaactcataggtattttctttaaaaaaaaaaattgcacactgggtgtggtagatcatacttgtaatcccagaactttaggcggctgaggcgggaggactgcttgagcccagtagttcaagaccaatctgggcaacatagcaagaccccatctctacaaaaaataagcaaaaactagctaggtgttgttgcgcacacctgtggtcccagctactcaggaggctgagacaggaggactgcttgagcccagcagtttgagaccagccttggcaacatgagacacacccaaaaaaaaaaaaacaaaacccaagcaaggtacacaccagggcagcttcagacacagccctctctagaggcttcagaagtgtaaactgcctgctgcaagggaatttaactcataattaaaaaaaaaaaaaaaaaggcaaggtgcccagggtggctcaaacctggaatcccagcactttgagcagctgaagcaggaggactgcctaaccctacgagttcaaaatcagtctgggcaatatagcaagatcctgtctctacgaaaaaaccaaaccaaaaccaaaaaaactagccaggtgtggtggtgcacctgtagtcccagctactcggcagaatgaagcgggacgatcgcctgagcccaggaggtcgaggctgcagcgagctatgactgcaccactgcactccagcctgggaaacagagcgagactctgtctcaaaaaaaaaaaaaagtaatgacaaataaataaaataaggcaaagagtggacctaaagcaccaagggattacagacaccagaaactgggcagtgggtttggaattgctctccaaaagccgaggcgtggtgcacagtgctcccgcctataatcccagtactttgggagggcgaagcgggagcatcgcttgggtccaggaattcaagatcagcctgggccacatagcaacgccctgtctctaaaaaaaaaaaattaaatggaaaaaaaaaaaaaagccaagcaaggcagacagcagggcagcttcagacgcacccctctctggaggcttcggaagtataaaccgccctctgcaagggaacttacaggttttttaaaatgaaataaaaaaaataaagaaagaaataagaaaaaaaatacaagaagaccccaggctttcgtttccagaggactagcacctgattccacctggaatggaacaggaggctcttaaggatttgggggtggaggcgccatgagaatagggctggaaacgcaaaaggaggaaaggcaggtgcgcgtttcctatttttccagaaggtaaaaatatctacgactgcccctggggtaagcggctccaggataaagagccttccaagcgcttaagagaatggactctcagtctatggaggcctggggagaggattctccagctctgtggcggaggccattggggcacggcccgggaaggctcctagtgtcagggccgggagggtcgcgagagggcctattcttgggtcaaggagaaacctgtcagagcctggaagagtgacttctggccgagcagggttcagggaaggtccccacctcaggtccctcgggtgtctctggccaccccaccttccacacaggcgcccgccgctgcccttccgggggcgaaagattccag

SEQ ID NO: 13030 - DNA, 20119 bp, Homo sapiens
tccctggaggagtcatcagattctcaatcttgcttgaagactgacaagatgtccctgtggactcccaaactctactccagatggggaggtgcccttaacaccaagattttaaaagctccaatttcagagcaagagtcgaaaactcacagataaagttatagttatttcagggttctgaaaagacgcagaacatgaaggtaagtaaaggctttattaacttgagacttcttagctattttttaaaacgttttatagcattttacctatttcatgtttaataaggattttagagtttaaaggatatttgaacgatacgcctttagaataacagaatcatttgattttactaagaaaaaaattcacgtatttacttattcttcatttgggtgaagtaatacaaataatatgtttctaaatacgttttttcaagtggactctttgtgaattaactagaaggtagaagggaaacacctccagaaaactgagtattaaaacagaatattgcgagaagtaagggggtttataattgtccaggcgtcaaggaaggaagcagaagatcctattggcacagaaatgaccctttctggttgatcgcttcatatagggactcagaagtctggcagcaacaaccttggctcttttcctggtgtttgttttcctgggaaactccagctgcgctccgcaggtaatcaaatgcaaaataaaaaattttaaaacaatgcgcactgtgtgtccactctgctctttctttcttccttcttgttttattctcttctttttcctttattttgctgtaatagaggactgagctgcaatgttttattaactgctcttcccttcccccgggctatagagactgttggagagaaggaactggactcctcaagctatgctctacctgaaaggggcacgtaagttccaaatatttcgctcttcctacaataatggaagacccctaggagtcaggaacagatagatggagagttatggagagagaataatgtcgagtttattcccttaaatcatcgaggccatcaaagagaccggtaggtgagggaggggtgggagaggggaagagtccctgattattggaaatcctccatccttattagaaattctccatccaaaactggagggttgcttctcttggtccaaatggggactcgggttgcctgggaaatatctcagtaacccgacctccgctccaaagcgcccttgcggcgtccggtcaggcgcggggctttcctccagagctccagggcccctggctcagcccggggttgcgctgggagcgctggaaactcggcagccccgcgcgaccctatcctggagcaacctgccccctccccacgcccggggactgcgctgtgccgggaggagctgaggtttaagcccgggttgtcccgggccaggctgtcgctgagccccaggtctcgtttttgcagagggtcgccgcttcatctccgaccagagccggagaaaggacctctccgaccggccactgccgggtgagtgaccaagggtgcaagggcgctagtcctgcgcttttggaataggatggggcgggcagggcttgctccgcgctggtgccgaaagaaagcgtctcctcaccggaaagacgcggctctgaggcgccctcagatacagtccgcccgagggcagcccgggttggcagcagcagcagctggatgccgagcgccggagctgggagctcgcgcgtccagccccgcgccaatggtggcaagggcggcccaggctggcgctgcggctccccaagccttattggcttgcggctgttcagccagccctctggctgccagggtgtgcagaggtccccagggagttaggacctgaggtgcagctcagaggggtaaggcgagataggaagaactatgcaaatgcttctagaaatgtatctgcgcgtttgtgcaggaactttactcagcctcctcttaaacgctgttattattaaaataagaacttacctaggaacttcaaatgtatgcttttgtttgactagaaagaactatcaaaggttcaaaatcaaaagagtaacatgcgggcagttaaggatgggaccggggactgttctttttcatgataaacctttccatcgtattgtattaacaaataacaatacaatttgatgaaattgtaaagattgaaatgctaaaattaaaaagtatacttacttggaaaaataccaaacactgttgaacacatagtaggtgcttaaatttttgtttaggctcttcaaacatgctgtgtaattgagcttatttattttatgaggttaagatttgtttctcaacttcagttgccccaaattagaaatcatgttttgtgctgaatcagaacaatttgtcttttttcaacttagatttgaaataactttgagttcttagcagatactccttcagtcaaataattaccttatatttggccgcaaaggttaaattattatctaaaattctctttggcatatagtttaacattctcttccataccctgtttgtaaacttgacataaccaattgtaagtcatttccaaggcaattgtgacatgttaaaaaattagtcttctgtgtaagtagtcctttgttgaggggtcaaaatctatttcatagaggtttttctagtattgctgcatgttagaataggacttatctacatcaatatataaatgctaagagaatctgtatacatttttgtttctgcagaaagacgaagcccaaatccccaactactaactattccggaggcagcaaccatcttactggcgtcccttcagaaatcaccagaaggtactagcatagtggcctctttcacctgcataacagaacagctttgcttactttcgggattctgtgttgagtgcaacacccctcccccagaatttcttggccttaggcccagaaattctaattctgtactgcttgagtgaggcccaagaatctctgtccttaagaagttcttccacattattctgatgattggtcaggtttgaaaacaggaacttcagagcccgttaataaaggttgaaatcatgagaatggagataccttctagggcttagatatagtgggaaaagggaagacaataaaacacccaaaaatcaagggaaatggggggaaatagtaccagtgaagggacattaaaaggagcaagcagaaaggtaagaggaaaatcagaataagagagtatcccagaattcattcagtagctgatgctactgatcccgctcctcttgaaactttccagggatggaaactatcagaatggttactatagcagaatggttagtaagaatacagaactcaggggacattaaacagtgtgtcacaggacttccccccacctcctgcccagtgacacagcttgctgctgctattccatatctgaaactttgtttacagaatgtgatacaagaaagtaaactgcaaagttaagagaaagcaggtctcaggctctggagagctggcatgactctcagaactcttgcagtgaaaaggtgtgaaatagttgaataacgggtagaggatgctgtatccaaggtgttctttttaaaacccaagacatggaacccagcgatttttggagtcagtacgaaaagagctctgatggagattggttgatagtgacgttttagatttgattgttgggaaaatgtgcagagccagaaaggaaagtgacttataatggacaagagagagctaattttaaagaggagaggtatcttcattagcaatttgaggaaaggatgtgattataggtccccatctcaagtcttttttggaaaataaatatgtatttttttaattattgaagttttctaagtggattgtctctgaagatgaaatgactaattttattagtctaaattgatagaaaagtttttgattcccatatgataaattaatcactagtcttctttagtatttttattctatactacctcattattatttagaaggctcttatttagtgaattatggtttcagtggaatttatacagggacgccgttctggttttgttttgttttgttttgttttcttccttccctttaaagagaagcccattttctgcaatggtttaaagtgtgctagaaattcaggttaagatgtaacccaaacattcaaattatattgcaactaactgaaagaatgtgcttttatctagaggtgatcttagaagaaattagtagatgcactttgcccctggccactgcttctccctaccgtattgtaacttttagtcattctatcctatttttagagtcccaggaacctgctattgtctaactctttaagtatccccacctcagaagtgatacctcatgctctaaagtttcgcgatcccagccagcaaacgagtgcctcttctttttgtctcatttcctccccagaactctagctcccctaataaaagaacatttgcaaatgtgttcccatgtcatctttcccgagcaagatccattttaacaggaaatataaagagacagtcctttgatgcaagtgaattattttaatggtgggtattttagatataagtcaatctgtgagagcaagacacatgacttttgagatttttaccagacataccatactgtagtttcagtcattatagaggttcagatgtaaaatatgaattccccaatgtgtcccaagctgagaaaaaaagattttaaactgagcaaatcaaagcccatattgtttaaattttcagtagcagagtccataagttaacatagcttagaaggctaaatgtttatttcctgagattctctttgtcttaccttttcctctattaaaacgcagagtgtatatttattttaaagaatttttttttcttacagatgaagaaaaaaactttgatcaaaccagattcctggaagacagtctgcttaactggtgaaaatatactggattatgtttaattatggttctattctctttgaaaacatgaaccatgtgaataaaacctttggacccttttattccatttgtaatcttaagaacacacacagatagttttattctttcagaaacaaaatatatataggatgcttagctgagaacatcatcttctttcattgcttcaggtcctgtttagatgaccaaaaatgttttcagatcaccttgtgtcttactcttgagtttcttagaatatttataattataaggctgaagactaaagtgttctttccttttaactatagccagtacctgtcttgatcttagttgtgtttttttttcattttgttacccacttgcattttgttttcactcagcagaaattctccttctctgttttccttttatcccatccccaagaatgtggaaggaaggtgagaaacatggcaggatgggaaataggagagtatgactctctatagctcatccaggagtaatcaattaagaagataaattggatgactgtggagaagctctgtgataggaacacttcagtgtggttgctgagaggagacagtcattgaggtagaaggtttgccaaagatccagagctcagagctccctttgtgctctttgggaattaccttgcattcagtttagaaacatggatctaaaagttactgggaaataagcagatggagacacactctgttgtttacgtattggaagaagggaacaagccagttttgttagaggtaactcattttccatgaccaaacagactcaacagattcaagtactctgcttactctaattgactagactctaggttttatttgacatcatagcattacataaatcactctgataacataagtgcacagtaatatgcctgatctcttcctttttaaaagccaacttgagttcagtaccatctgaatacacacacatgcacatatacccacacacgcatacacacatactcctgtggcaaacataataatgtatttatttagaattataatatgaccatcatgttaattattttttacctaatcagagttgttattgacaaatgtcataagtggaaagtattaattcttattgtcatcagtatttagccattatttagtagctcaagaatatctttatgtgaatgtctctgtaacttggaattgcaatttcactgtgttaagtaatcagaactctgcttataagatttatctgtatcttgtttcataatttaataatgaaactaaattcaagttaatgtaatgttgatctccgtcgaaaaataacttgtgagcattaaaatatctgtatggcattataataggcacctgtcattaattatgatttgatttgaaagtagacttactaggtagtgcttacatctgatttattgaaaattttttccaaaagcattgtcttttatttatacagtcctaaccacttcaccattaggaggggtgggacattaaaaattatttacccatcagacataaaattgtacaaattgactattcaaaatagtatgtgtattcaaagaacacttttaacatctatcttatgaaataattcttcctacaactaaccagaacaatctcaaaaatgtcatactaaccattgttttaaaagctgtctcaatgatcaatagctgttaaaatatagctccaagtattctaagtactcaaattccttgaatgttcttatgtacaaatatgctgattaattaaaaggtccctcttcccaattttctataactttccaactctcttatggtgtctatattctgtttatttctagatttttaaaaaaccaaaatgaacaagtgatcatagatcagaaaaccttcacattatatggcttgtgttttaaaattgggaattttctggcttcaacacacagatacatgcactagaataccttgatctgcagggagcgctttcagccactttctgcacagttctcattgcccttctcttttttgcctctatagcctacctcggctatctggcctccatcctgggctcttaattattctttgttttccagtagttgccttcgctccctcaataccatcattgtgttcctaagagaggagagaagaaggcgaagtgaccctggcttgttcagattagcctccagcttgcatttcttctttacctggttatgataaatgaaaatgtgtatcttacaatcttgaattacattattttatcttgaccacaaagaaagggaagttgggaatgtaacttcattctgttcggtcgcttcatactgggctataaattcctttagaaagagctcatttttaatttgatttgatcctcacaacaactgtgtgaaatgggccattttattgcccttagtactcatagaaatttgggttcattcagtgaagactcttcggacctccctaagtagacttaactagtccccctcctgagtcttccttgtaccctggaaaactattagtataacaccttgtaacatttatgttctcatctgcatatataaaaccagttctgttcactctaactcttactatggaagagacagtagtatcttgatcagttcaggctgctaaaacaaaataccacaaactgtgtggcttataaacaacagaaatttatttctcacaattctggagcctgagaagttcaagatcaaggtgtcaacagaatcagtgtctggtagaaggcccatttctcatagatggcgctttcttgctgtgtcctcacgtggtggaaagggcaaggcagctctctggggcctcttttataagggcagtaatcctattcatgagggctctgtccacatgatctaatcacttcccaaaggctctgcctcctttgtggataccatcacattggggattaggatttcaatacagacgggcccaacttatgatggttcgatttatgatttttcaactttatgatgggatgaaagcaacacacagtacactccttgacttaccatggatttatattctgataggcccattataaattaaaaatatcagtgggctggccaggcatggtggctcatgcctgtaatcccagcactttgggaggccaaggtgggcacatcacttgaggccagaagttcaaagaccagcctgaccaatatgccaacaccctgtctctactaaaaagaaaatacaaaaattagccagctgtggtggcacatgcctgtggtctgagatacttgggaggctgcagcacaagaattgcttgagcctgggaagtggaggttgcagtgagccaagatgacaccactgcactccagcctgggtgacagagcaagactcttgtcaaaaagaaaaagaaaaagaaggaaagaaataaagagagaaaggaaaaagaaagaaaagaaaaaggaaagaaggaaagaaagaaaaaagagagaaggtaagaaagaaaaaaagagagaaagaaagaaaaaggaagaaagaaaaaatatcagtgggtttatccaaacataatcccattgtaagttgaggagcacctatatatgaatttggggggcacacaaacattcaaaccatagcaggtggtacaatccataaaacgggtctttctctcagctgatcaggcaccacacacgttttctatagttcctgtccttcaatttatgaatacatacattctttaaaagcaaaattttttgaacctctatgtctcccaataagaccatttatctatgcaactattatgtacaaggcactgtactagacacagagccttctactaaaaatcatatttgcttctcctcaccagcttttgtcggtcttggggaaaaggatgaagaaatgactacagtggagagatggagtcacctggcagcagctgtctgaataggggactgagtacaggatagaaggtgattcctacacatactgccaaagccaggtatttgtaagtcagctaaattccatgtgccctatcatttgtacacacttattatcatcaaattattatttcattgaacaaaaagcacttacatcttcaggtattttactgtgtaggcatgttttcaataacagtcaagcaaccagttaccaatcgagtatcatttgaatagacacgttaagctagtttactggggatacattttcatggttattgtaacagtgaaccctagtttatcacagtatctttctggtacttcagggaatgagcctataatataagtccttctcatattttttctactctccagtacagagcatttcaaactgctctgcagatgctcggttaattggcatccacagggcatttgtcaaaggctagattttaggtcaattatttctcttctttctggacatctaagtaaagtaaatttccagctatcttccatttttgtctgatttgctgcttgtatccaacagttttctacttttttctagctactgcagcaataggagggctggattacagttttccagtggtcttgaaccatctgacaccttgtcgttgctgctattccatttttgtgatcaataatccagcactgagaagaccaaaacttttttagaacctcttcagaacaaggccaattgatatgtcaataaaggaactcactgtgagttaagtggaactcacaatgaataactacttagttagcaaaaaagcaatccaagagtgtgatttttgtttttgttttgttgccaatttagacttaattacacttaaaacataaatcggctaaattaataatcattcatctatgactctatgcacatcacagaatatgttgagacattgtcattattacaactgaatagatgttctattttttctattttttaaaaagatagcttctctaggaattattcataacagctgcttcccacatgttattcgaatgtctaaacaatttttaaagaaggcattatcagtgaaagttgttattcaatattaatgtgtttatttacttggatttaacaacttatcatctatgaagaaacaaggcattaccagtgaaagttaagttattaaatattaatgtgtttatttacttggattttacaagttatcatctatgaagattgaccaaattttaaaaaggctttctatttaaacaatagaaaaatgttacagtaagatggtggtaccatgtacatggtaatatcttgcattaattacaacatcaattctagatttcaaaagtgacataaatgtccattaatatgcatcaaaatatggacttaggatagctattcactcatggatttttgtctctgcaaaactacatctaaatcatggttctgatgcatgtgaaaaatgaaaataatcagtaaaaacctagctatttaaaaaatgtaggtagtgcacattcatgggtaagatcaaggttttcgggggggaaatgggaaatttgtgtggtggggtagagaagctgcataaatagtaagcaaaggattatgatgatcatttaaaaataaacagagtaagagaaaatccttaccacttaaattcaccattttaaaaacacttttccgtcttctgcctttaatgagtgctcctcctcatgcctaactttatgggggaaacaagagttggggaaaataacttggatcttatcctaaattacaaaattgtcattcactcaatttcttccactttttaggcagagaataaactccattgtaatacttagaaggagaaaatgaaatttgtggcatttttattttaaataattagtcttactttgcttttttaaattagctcttcatgcagcacatgtagaattcagttcttatattcaccatgcagctttttcttcccatgaggaacgtggctcagtgaaaatggtgacttgatatttaaccgatccctttcagcctcctcttcctcatcgtatctctcatcctccacttcatcttccacatcactgctctgaggactggaggcctgagaccctgaaggagaaggtggtactgaggaaggcctgggatatttaaatccttctgtctgccaaagacaaaaataagacataaacatcacaacagtttcttggctttcaacgatgtaaatactatgcatgcactatcaattttttaagtagttatctatcttttgtagtctgggtgctattaaactttgattcattttgattttgataccaccaatctcaagagggattcattcaatatatagctattctttattaagtactgaaatgtgctaagtgttatatacatattattatcatcttatcttttaacaacactctgataaatatgtttttttcagtacagaagaaaatggagggttagaggggtcaagtaacttgcccaacatcactcagcacataaatggtagagcaaagatttgtaccaggtctgtgatgactccagaaactttaatgtcaactgccaccttacactgctgatactgttagtctctaagtctcaaatttgttcagcaaagcttttggatgtggatagcctggaaatgccatggatggccaccactagaaggcatcctggaagtcaggtcacttaattgactctacaattccactagttgctgttatttcagttaatgagaaaatatcactagactttaattaatttgcccttctacttgagatactgagataacttatttgataaacacacactgcaatgccactaaagaaaccagatgaaaaaacatgattggagtgcatataattgaatggggagacagatgtgtaaaagtgttatagcgctcgtcactctgtatttcaattactttatacattatatcatgtcatacatgtacagtcattttaaggttcagatactttacctgtcagcaatacaacaaaagaactgagttctgcacttgagacctagcttgaagtaggtgctcaatgcttattagacgtaataactggataaataagtagataagcagataaatggatgaatattgctgaattatcattaagtggaatgaccacctctgaataagctaagcaatcaactctgaatgctagaatcataaacatgaaagtcagaatttgtagcctgagggtttaagaaaaccttatcaccttttttacgggcaaattttacttcaggttaactttctagatctgttcctctggaaacctgatataggtggaatataagtcatgttattagggatggttgtttatggtaacagtgacccctgattgagaaattatatctgaactgaaaaatctataaatacttgataaggcgccagagtttttgggaatctctgaatgactcttataagatgactcataattgggcatattccttgcagggagcatgaaagctggtttgcggagatttacatgagatagaggctcctgtggggcatgcagctactaagctaaggtgatctcatttgcaatggtatgggtcttatcttcttgcacctaagctgtcacctagtgtgtaggcggccaaagatgtttagctcttggattgctgtgtagactactgcaaggactgatcccactaaagagaaatgcctgacgctcccctgcttcaagtggcacctcatgtcttctccctgctaagtgaatctgatgacaaatgtggcctatagcagtcttatgaacataaacgtctagttggattttagaagaagacaccctggtgggcactgatgaatggaccataaatgctcatctagttcaattcctcctggggtgctgaacttactctattttactcttgccaagcggtcaccctatatttaaacacttccttggagagcaaattcactttcaattaaagcagtccagtttgtttttgaacaactccccaaagaataaatgtccatcagaaccatttcaagcattaaggcagagaaagttttaattcagagatgcttctccaatgagatgaattaactgtcttgagagctttaggacagtctgatttgtgagttcctctctctctcctttggtttgattcaacattatgaaaaagtatcatagcttgtgtgcatagctacttccaaatttaaatgtattatttaaacttataaaaagaaatatagctttcaaaaaaaaatacattgaatatttaccgttggtggtgatgttagttccacatggaatttatctggaaaagctctgcttaatgtcaggtgtctggcatgctggtaatactattgatagaaagccaaatcacaggttaataaaaacccttagatatctcaataatcaagttattaaataaggccttattctcctagttctgaaacatatgtattttttaaagtgacagaatctatgcagtctaagtttgagactcaggaaagaaattacagtttatagttttactatttttcaacccataggcagagtaatactataaaatgctggggaagaatgcccatactggtcatattgagctctgaattgagcattaaggtgactgaaaacactggtttcattccacagagaagcagtgtggcatggagaaaagatagggcctgaatattcagataaattgggtgtaaatcctgcttcagaccttaggcaagaaacatcacttctaaaagcctagtgtatctatcttcattgcaagatggagatagtaaaattaatcatccaggttgtaatgagcactggcatttgtgtgtgcagatactcagcaaatggcagcatctctcattcagccaagagtgttcagcactgtgcaaacagacacattatgtgaaggcaaagtcaattcatttattattaaatcaccactgctaagctgtgtgagcatccaggtgtttataaacctattgcatgattgaaaggaggtatttcctgtagtcatcattttgaaaaaccatattatacccattactcactacagttgagaaatatgactacactatttctctagagagaaacaaagtagggacttttctcttgatgttttcttcaacttcataaaatgtttccttataccagtaacacatcaagtgaggcactgacaatggaatagctagtaagatcagtgctagatcctgatggacttgctattatgaatagactcaaacgaaacatgaagaaatacatataggactttgtaaacttattaaattttaaaaagtacatggagacactgagattttaacaattataatattggattaactttagagattatgactagaatcaatatgtttatagtccagtggaattttttaagtggtctgctgtgtttatctaaacttgcttactctgcctaagtatctccaatccagaagatctgagagcctctcagttctgttcctctggataatcctttggcggcgtgactgtttgcaaaatccatagagaaacttagtcagctgattgcaagaatcatctggagaacggaaccgcctgtcaacgatgtaaatacctgaagaacacaaaagccaaagcacaagtaaaagtaggactaaccttaaacatttgttctcctgtgatttactaactctttggttccatcaaaaacctatgcattatctaccccctgactcaggaattacccccactttattcttttctgaggccctaattcccttctaatggtttacaaccatcactgacacacagccaacgaagtggatcttgctgaaaaaaactctggcagtctagggatacgctggatcagtgatcctccatggggttgctcactaaccagaatttccagggcggggcctggatatctgtgccttttatgttccccagtgttcccactgttcagccgaggctgaaaaccccagatctagcctgaggaaagagccacagtacacccataaaagactgagggaaggccagggcttggtagctcacacctgtaatcccagcagtttgggaggcagaggtgggtggattccttgagcccaggagttcaagaccaacctgggcaacctggggaaatcccatctctacatacaaaatttagccaggtgtggtggtgtgcgcctgtagccccagctactcgggaggttggggcaggagaatcacctgagccagaaatgtggagactgcagtgagccaggatcaggccactgcactccagcctgggcaacagagtgagaccatgtttccaaaaaaaaaaaaaaaaaaaaaaacaaaaaacccagggaaatggcaatgtattggcagacaatatatcccattttaacttttcttgctgctagggaatatgaacagacagataatggtatgcaaattattctgccatcttaaacaatttaggtgaactttgctaagttgtcacgggcctttaaaataataacagtaatgataacaataataataatatatgtactatctaatgaccaatatatgcactctaagaccatggttattgtcatatcatttctaggcagcagaagggatcaaaattcagggaggaaaaaggtaaaggacaaagtttgtccaagttttgcactctttttgcagtttgtctcatgggcaatatattaatattaatagcattcttatgttatctgtgggccacatatttaaagctacttttttttctccacttttagtttaggttcagggggtacatgtgcacatttgttagatgggtacatttcatactgctgaggcttggtgtacaaatgatcccatcgcccaggtgattaacatagtgcctggtaggtagtctttcaacccacgccccttcccccactccccactcaagcagtccccagatgtctattgttcccatctttgtgtctatgtgtattcaatgtttagctcccacttataagtgggaacatgcagtatttggttatctgttcccgcattaattcacttaagataatgacctccagctgcgtccatgttgctgcaaaggacagaattctatttataaatctactttttttttttatgagacagcctgaggctctgtcacccaggcaggtgtgcagtggcacgatctcagctcactgcctcctccgcctcccaggttcaagtgattatagtgcctcagcctctggagtagctggaattacaggcgtgcaccaccatacttggctaatttttttgtatttttagtagagatgggattttgccgtgttggccatgctggtctcgaacccctgacctcaagtgatccacccacctcggcctcccaaagtgctgggattacaggcatgagccactgtgcccagcctaaattgacttttaattaaacaagaaatataaaaacattagtttaattatcaggatagctttagagttaggctctgtaaagaccctgtgctttgtttggttagaggtcatgtctccccagcatgggttaatgatgaaaaccctcaccgtaagcagtaggatcagccacgtgctcctgcatgaaacagccaaacccggagagattcgtggtcacactggggatacccatcacagtgcattcagctgccaggggaaatagaccaaagcttggcttcagaccagcgcctatatccttgtatgcactcagaggaggaaaaggccctagtcctcctaagaatagcaatgttcactatgtgtcagtcacaacactaaactctttacatgtctcactaacttatttaatctctcaacaaccctgtgaagtggggccatcattatccccatcttacagctgaagaaatgaggcacagagaaattaataactttcccaccttcacaaagccagggttcgtggtatagctgggatttgaagtcaggcacccggctgcagaacccttgtgcggaactgccgggctccactgcagcttcaatcccagctggttttgtttcttgcttctttctagcctgtgtttctaagtacttggcaagtttatgaggtaggttaaatatgttttggatgcgaccagcttcttcccccatttaaatctcccttggcacatattccttccactctctcaggagctcaataaatggatgatctcttgcagtcctccctcaccttttaatcaaaatctgttttccaggaaataactgatatgtcttaaaaattttactagtctcaaggatgtctacatttttaggaatttatatttgataatggaattacccttggttggtgagtggagttggatgaaaaaaagatcttcccattacccatgaagtaatacaatctagacagcaaccttatctcttgctctgcaaatgtttcctcttggtttagctgtatagctgtggagttgtggttctctaattttagtggtgggtggtgcagaggaggaaagtgggatggggactatcagcccttttgagagtctgatgaacattttggaactcctctccagaaatattcttctttttttaatttttacacacttttatttcctcagacttcctcctggactcagctccaccttctatgggagttgggagttggagagtatctcttattttcttttttaaaaaattttactttaagtctgggacacatgtgctgaacgtgcaggttcgttacataggtatacatgtgctatggtggtttgctgcacctatcaacccatcgtctaggttttaagccctgcatgcattaggtatttgtcctaatgctctccctcacctcgccccacaacccgacaggccccgatgtgtgatgttcccctccctgtgtccatgtgttctcattgttcaactcccacttatgagtgagaacatgcggtgtttggttttctgttcctgtgttagtttgctgaggatgatgaagagaaatattcttatacacatatgtatacaaaattttgtctacaatgccgtgaaagttcacagatccttcatgtttattaaatggccatcaattcactatgtagtaatattccaggcacccatgaagtttagtatatgttcattgaattaatttaatgaaataaatgcttatatttatttggctctctgaaaacacatttggatgaatgctttctagagtgagttaagtctagtaacacgtaaaaagattattctaaaaacattagcaagttatctaatatgctaatgttaaatgtataccaccagaagtcgcattcttcctgtaactataggttaggggaagagtgaccagctccctttggttaatgtaaaacacagcatgactcattcactatggactattccacaaactcccttatttgtctatttataatatcctttgtaacatcttctttggcctttatcttaaaacagtagatatatctcctctatcattttgggttgttaagtttaactttgccctataaaatgacactttggtggacagtcagctgttagttctataacattttcttgacccgacagaaaggacttcccacattgcctcagtcactcatgcatttggttgtatactcttctatccatgatacttccaatagtaaattgttttactagaaataataagaacaaggtcaaaaacaaagtgttaagttcatcagtgaaacgtgtgctttatgtatctcaaaagatagtgcattgcaagcaatttgagatatttatgtggacatttcctaagtaagaagacaccaccttcacaaaagtaggccacttttagatctgcaagagagatacccggaagagttagatacaaatatttcctatgtcatgtttcaagacaatcctttgtctattttccccaagaaattttaaagtttttatagctgctggcaaattatgcttggtgaagctagaacaatagaataggaccttatgaccaaacatgcccagccctcatgttgttcctgctgtaaataatacaggatcctatttttgtagacttttaaattctgtattttaattctaggataaagatgcaaataatagaaaaaattcttcctcttcataattcagcctattattccctctcaccttggcctctgctgctccttacttgagctttatatcaatgataacattgagatacaaaaggcaacatttactatctcaattataaataaaaatgttttctgaactttttaaaagtcacaagtgaagaggccgggtgtgatggctcacgtctataatcccaccactttggggagccaaggcaggtggatcagttgaggccaacagtttgagaccagcctggccaacatgatgaaacctgtctctactaaaaacacaaaaattagccaggcgtggtggtgtgtgcctgtaatcccagctactcaagaggctgaggcacgagaatctcttgaacccaggaggcgaaggttgcagtgagccaagatcatgccactgcactccagcctgggtgacagagtgagactccgtctcaaagaaataataataaaatcacaagtgaaactttatttacattgggcagaaaaatatctgattattaataagagatggaaaagttattgttgtattctttgcattggcatgtatttaaagtatttgtttcccttttaattagacatttcagtacaagtacaaattggtcgctcttgatgctaatggcaaccatgccagttcggtccagaaaagaaaaatacatagtaaacctgagaaactaccatctgttaaaaaataaaataaaataaaataacaaaggagggtgaagaaggaggagtttctgaatggaatgatgtcattgttgacaataccactgaattgctaatctctcttagtaccttttattttgaggcacaagaatgtgaagaagacttttcactgtacacctttttatatttatttccctaaccatatgactgtgttacccattacatattaaatatgttcattaaattttaaaaagaattattctaaaataatttttaaagaacaacattgctagactattatttattatattaatcctacttacagtcaatttctccttcacactaataaatggggcagatagagatagctaaataagatacaacctttatatcacattcctttttctttggaattcaatgaggcaatacctcacatacctcctaaaatatgcccaaaccgtggtatacttatataatcttcatccttattcttaagtaattatctacaaatcataaattaatccctgtgataaatccaaccaaaattttttaaaactgaagaattgaaatcttattagaaatttaatatcaactttgaatattatatatatgcacataaaataatatactaacaaaattcaaaacattccacactctatacatgacacatacctggagtataaccccagggttcatagtatgatggaaatactccaagatgacaacctc

SEQ ID NO: 13031 - DNA, 20119 bp, Homo sapiens
  misc_feature (1289)..(1289): n equals a,t,g, or c
tccctggaggagtcatcagattctcaatcttgcttgaagactgacaagatgtccctgtggactcccaaactctactccagatggggaggtgcccttaacaccaagattttaaaagctccaatttcagagcaagagtcgaaaactcacagataaagttatagttatttcagggttctgaaaagacgcagaacatgaaggtaagtaaaggctttattaacttgagacttcttagctattttttaaaacgttttatagcattttacctatttcatgtttaataaggattttagagtttaaaggatatttgaacgatacgcctttagaataacagaatcatttgattttactaagaaaaaaattcacgtatttacttattcttcatttgggtgaagtaatacaaataatatgtttctaaatacgttttttcaagtggactctttgtgaattaactagaaggtagaagggaaacacctccagaaaactgagtattaaaacagaatattgcgagaagtaagggggtttataattgtccaggcgtcaaggaaggaagcagaagatcctattggcacagaaatgaccctttctggttgatcgcttcatatagggactcagaagtctggcagcaacaaccttggctcttttcctggtgtttgttttcctgggaaactccagctgcgctccgcaggtaatcaaatgcaaaataaaaaattttaaaacaatgcgcactgtgtgtccactctgctctttctttcttccttcttgttttattctcttctttttcctttattttgctgtaatagaggactgagctgcaatgttttattaactgctcttcccttcccccgggctatagagactgttggagagaaggaactggactcctcaagctatgctctacctgaaaggggcacgtaagttccaaatatttcgctcttcctacaataatggaagacccctaggagtcaggaacagatagatggagagttatggagagagaataatgtcgagtttattcccttaaatcatcgaggccatcaaagagaccggtaggtgagggaggggtgggagaggggaagagtccctgattattggaaatcctccatccttattagaaattctccatccaaaactggagggttgcttctcttggtccaaatggggactcgggttgcctgggaaatatctcagtaacccgacctccgctccaaagcgcccttgcggcgtccggtcaggcgcggggctttcctccagagctccagggcccctggctcagcccggggttgcgctgngagcgctggaaactcggcagccccgcgcgaccctatctgggagcaacctgccccctccccacgcccggggactgcgctgtgccgggaggagctgaggttaaagccggttgtcccgggccaggctgtcgctgagccccaggtctcgtttttgcagagggtcgccgcttcatctccgaccagagccggagaaaggacctctccgaccggccactgccgggtgagtgaccaagggtgcaagggcgctagtcctgcgcttttggaataggatggggcgggcagggcttgctccgcgctggtgccgaaagaaagcgtctcctcaccggaaagacgcggctctgaggcgccctcagatacagtccgcccgagggcagcccgggttggcagcagcagcagctggatgccgagcgccggagctgggagctcgcgcgtccagccccgcgccaatggtggcaagggcggcccaggctggcgctgcggctccccaagccttattggcttgcggctgttcagccagccctctggctgccagggtgtgcagaggtccccagggagttaggacctgaggtgcagctcagaggggtaaggcgagataggaagaactatgcaaatgcttctagaaatgtatctgcgcgtttgtgcaggaactttactcagcctcctcttaaacgctgttattattaaaataagaacttacctaggaacttcaaatgtatgcttttgtttgactagaaagaactatcaaaggttcaaaatcaaaagagtaacatgcgggcagttaaggatgggaccggggactgttctttttcatgataaacctttccatcgtattgtattaacaaataacaatacaattttggatgaaattgtaaagattgaaatgctaaaattaaaaagtatacttacttggaaaaataccaaacactgttgaacacatagtaggtgcttaaatttttgtttaggctcttcaaacatgctgtgtaattgagcttatttattttatgaggttaagatttgtttctcaacttcagttgccccaaattagaaatcatgttttgtgctgaatcagaacaatttgtcttttttcaacttagatttgaaataactttgagttcttagcagatactccttcagtcaaataattaccttatatttggccgcaaaggttaaattattatctaaaattctctttggcatatagtttaacattctcttccataccctgtttgtaaacttgacataaccaattgtaagtcatttccaaggcaattgtgacatgttaaaaaattagtcttctgtgtaagtagtcctttgttgaggggtcaaaatctatttcatagaggtttttctagtattgctgcatgttagaataggacttatctacatcaatatataaatgctaagagaatctgtatacatttttgtttctgcagaaagacgaagcccaaatccccaactactaactattccggaggcagcaaccatcttactggcgtcccttcagaaatcaccagaaggtactagcatagtggcctctttcacctgcataacagaacagctttgcttactttcgggattctgtgttgagtgcaacacccctcccccagaatttcttggccttaggcccagaaattctaattctgtactgcttgagtgaggcccaagaatctctgtccttaagaagttcttccacattattctgatgattggtcaggtttgaaaacaggaacttcagagcccgttaataaaggttgaaatcatgagaatggagataccttctagggcttagatatagtgggaaaagggaagacaataaaacacccaaaaatcaagggaaatggggggaaatagtaccagtgaagggacattaaaaggagcaagcagaaaggtaagaggaaaatcagaataagagagtatcccagaattcattcagtagctgatgctactgatcccgctcctcttgaaactttccagggatggaaactatcagaatggttactatagcagaatggttagtaagaatacagaactcaggggacattaaacagtgtgtcacaggacttccccccacctcctgcccagtgacacagcttgctgctgctattccatatctgaaactttgtttacagaatgtgatacaagaaagtaaactgcaaagttaagagaaagcaggtctcaggctctggagagctggcatgactctcagaactcttgcagtgaaaaggtgtgaaatagttgaataacgggtagaggatgctgtatccaaggtgttctttttaaaacccaagacatggaacccagcgatttttggagtcagtacgaaaagagctctgatggagattggttgatagtgacgttttagatttgattgttgggaaaatgtgcagagccagaaaggaaagtgacttataatggacaagagagagctaattttaaagaggagaggtatcttcattagcaatttgaggaaaggatgtgattataggtccccatctcaagtcttttttggaaaataaatatgtatttttttaattattgaagttttctaagtggattgtctctgaagatgaaatgactaattttattagtctaaattgatagaaaagtttttgattcccatatgataaattaatcactagtcttctttagtatttttattctatactacctcattattatttagaaggctcttatttagtgaattatggtttcagtggaatttatacagggacgccgttctggttttgttttgttttgttttgttttcttccttccctttaaagagaagcccattttctgcaatggtttaaagtgtgctagaaattcaggttaagatgtaacccaaacattcaaattatattgcaactaactgaaagaatgtgcttttatctagaggtgatcttagaagaaattagtagatgcactttgcccctggccactgcttctccctaccgtattgtaacttttagtcattctatcctatttttagagtcccaggaacctgctattgtctaactctttaagtatccccacctcagaagtgatacctcatgctctaaagtttcgcgatcccagccagcaaacgagtgcctcttctttttgtctcatttcctccccagaactctagctcccctaataaaagaacatttgcaaatgtgttcccatgtcatctttcccgagcaagatccattttaacaggaaatataaagagacagtcctttgatgcaagtgaattattttaatggtgggtattttagatataagtcaatctgtgagagcaagacacatgacttttgagatttttaccagacataccatactgtagtttcagtcattatagaggttcagatgtaaaatatgaattccccaatgtgtcccaagctgagaaaaaaagattttaaactgagcaaatcaaagcccatattgtttaaattttcagtagcagagtccataagttaacatagcttagaaggctaaatgtttatttcctgagattctctttgtcttaccttttcctctattaaaacgcagagtgtatatttattttaaagaatttttttttcttacagatgaagaaaaaaactttgatcaaaccagattcctggaagacagtctgcttaactggtgaaaatatactggattatgtttaattatggttctattctctttgaaaacatgaaccatgtgaataaaacctttggacccttttattccatttgtaatcttaagaacacacacagatagttttattctttcagagacaaaatatatataggatgcttagctgagaacatcatcttctttcattgcttcaggtcctgtttagatgaccaaaaatgttttcagatcaccttgtgtcttactcttgagtttcttagaatatttataattataaggctgaagactaaagtgttctttccttttaactatagccagtacctgtcttgatcttagttgtgtttttttttcattttgttacccacttgcattttgttttcactcagcagaaattctccttctctgttttccttttatcccatccccaagaatgtggaaggaaggtgagaaacatggcaggatgggaaataggagagtatgactctctatagctcatccaggagtaatcaattaagaagataaattggatgactgtggagaagctctgtgataggaacacttcagtgtggttgctgagaggagacagtcattgaggtagaaggtttgccaaagatccagagctcagagctccctttgtgctctttgggaattaccttgcattcagtttagaaacatggatctaaaagttactgggaaataagcagatggagacacactctgttgtttacgtattggaagaagggaacaagccagttttgttagaggtaactcattttccatgaccaaacagactcaacagattcaagtactctgcttactctaattgactagactctaggttttatttgacatcatagcattacataaatcactctgataacataagtgcacagtaatatgcctgatctcttcctttttaaaagccaacttgagttcagtaccatctgaatacacacacatgcacatatacccacacacgcatacacacatactcctgtggcaaacataataatgtatttatttagaattataatatgaccatcatgttaattattttttacctaatcagagttgttattgacaaatgtcataagtggaaagtattaattcttattgtcatcagtatttagccattatttagtagctcaagaatatctttatgtgaatgtctctgtaacttggaattgcaatttcactgtgttaagtaatcagaactctgcttataagatttatctgtatcttgtttcataatttaataatgaaactaaattcaagttaatgtaatgttgatctccgtcgaaaaataacttgtgagcattaaaatatctgtatggcattataataggcacctgtcattaattatgatttgatttgaaagtagacttactaggtagtgcttacatctgatttattgaaaattttttccaaaagcattgtcttttatttatacagtcctaaccacttcaccattaggaggggtgggacattaaaaattatttacccatcagacataaaattgtacaaattgactattcaaaatagtatgtgtattcaaagaacacttttaacatctatcttatgaaataattcttcctacaactaaccagaacaatctcaaaaatgtcatactaaccattgttttaaaagctgtctcaatgatcaatagctgttaaaatatagctccaagtattctaagtactcaaattccttgaatgttcttatgtacaaatatgctgattaattaaaaggtccctcttcccaattttctataactttccaactctcttatggtgtctatattctgtttatttctagatttttaaaaaaccaaaatgaacaagtgatcatagatcagaaaaccttcacattatatggcttgtgttttaaaattgggaattttctggcttcaacacacagatacatgcactagaataccttgatctgcagggagcgctttcagccactttctgcacagttctcattgcccttctcttttttgcctctatagcctacctcggctatctggcctccatcctgggctcttaattattctttgttttccagtagttgccttcgctccctcaataccatcattgtgttcctaagagaggagagaagaaggcgaagtgaccctggcttgttcagattagcctccagcttgcatttcttctttacctggttatgataaatgaaaatgtgtatcttacaatcttgaattacattattttatcttgaccacaaagaaagggaagttgggaatgtaacttcattctgttcggtcgcttcatactgggctataaattcctttagaaagagctcatttttaatttgatttgatcctcacaacaactgtgtgaaatgggccattttattgcccttagtactcatagaaatttgggttcattcagtgaagactcttcggacctccctaagtagacttaactagtccccctcctgagtcttccttgtaccctggaaaactattagtataacaccttgtaacatttatgttctcatctgcatatataaaaccagttctgttcactctaactcttactatggaagagacagtagtatcttgatcagttcaggctgctaaaacaaaataccacaaactgtgtggcttataaacaacagaaatttatttctcacaattctggagcctgagaagttcaagatcaaggtgtcaacagaatcagtgtctggtagaaggcccatttctcatagatggcgctttcttgctgtgtcctcacgtggtggaaagggcaaggcagctctctggggcctcttttataagggcagtaatcctattcatgagggctctgtccacatgatctaatcacttcccaaaggctctgcctcctttgtggataccatcacattggggattaggatttcaatacagacgggcccaacttatgatggttcgatttatgatttttcaactttatgatgggatgaaagcaacacacagtacactccttgacttaccatggatttatattctgataggcccattataaattaaaaatatcagtgggctggccaggcatggtggctcatgcctgtaatcccagcactttgggaggccaaggtgggcacatcacttgaggccagaagttcaaagaccagcctgaccaatatgccaacaccctgtctctactaaaaagaaaatacaaaaattagccagctgtggtggcacatgcctgtggtctgagatacttgggaggctgcagcacaagaattgcttgagcctgggaagtggaggttgcagtgagccaagatgacaccactgcactccagcctgggtgacagagcaagactcttgtcaaaaagaaaaagaaaaagaaggaaagaaataaagagagaaaggaaaaagaaagaaaagaaaaaggaaagaaggaaagaaagaaaaaagagagaaggtaagaaagaaaaaaagagagaaagaaagaaaaaggaagaaagaaaaaatatcagtgggtttatccaaacataatcccattgtaagttgaggagcacctatatatgaatttggggggcacacaaacattcaaaccatagcaggtggtacaatccataaaacgggtctttctctcagctgatcaggcaccacacacgttttctatagttcctgtccttcaatttatgaatacatacattctttaaaagcaaaattttttgaacctctatgtctcccaataaaaacatttatctatgcaactattatgtacaaggcactgtactagacacagagccttctactaaaaatcatatttgcttctcctcaccagcttttgtcggtcttggggaaaaggatgaagaaatgactacagtggagagatggagtcacctggcagcagctgtctgaataggggactgagtacaggatagaaggtgattcctacacatactgccaaagccaggtatttgtaagtcagctaaattccatgtgccctatcatttgtacacacttattatcatcaaattattatttcattgaacaaaaagcacttacatcttcaggtattttactgtgtaggcatgttttcaataacagtcaagcaaccagttaccaatcgagtatcatttgaatagacacgttaagctagtttactggggatacattttcatggttattgtaacagtgaaccctagtttatcacagtatctttctggtacttcagggaatgagcctataatataagtccttctcatattttttctactctccagtacagagcatttcaaactgctctgcagatgctcggttaattggcatccacagggcatttgtcaaaggctagattttaggtcaattatttctcttctttctggacatctaagtaaagtaaatttccagctatcttccatttttgtctgatttgctgcttgtatccaacagttttctacttttttctagctactgcagcaataggagggctggattacagttttccagtggtcttgaaccatctgacaccttgtcgttgctgctattccatttttgtgatcaataatccagcactgagaagaccaaaacttttttagaacctcttcagaacaaggccaattgatatgtcaataaaggaactcactgtgagttaagtggaactcacaatgaataactacttagttagcaaaaaagcaatccaagagtgtgatttttgtttttgttttgttgccaatttagacttaattacacttaaaacataaatcggctaaattaataatcattcatctatgactctatgcacatcacagaatatgttgagacattgtcattattacaactgaatagatgttctattttttctattttttaaaaagatagcttctctaggaattattcataacagctgcttcccacatgttattcgaatgtctaaacaatttttaaagaaggcattatcagtgaaagttgttattcaatattaatgtgtttatttacttggatttaacaacttatcatctatgaagaaacaaggcattaccagtgaaagttaagttattaaatattaatgtgtttatttacttggattttacaagttatcatctatgaagattgaccaaattttaaaaaggctttctatttaaacaatagaaaaatgttacagtaagatggtggtaccatgtacatggtaatatcttgcattaattacaacatcaattctagatttcaaaagtgacataaatgtccattaatatgcatcaaaatatggacttaggatagctattcactcatggatttttgtctctgcaaaactacatctaaatcatggttctgatgcatgtgaaaaatgaaaataatcagtaaaaacctagctatttaaaaaatgtaggtagtgcacattcatgggtaagatcaaggttttcgggggggaaatgggaaatttgtgtggtggggtagagaagctgcataaatagtaagcaaaggattatgatgatcatttaaaaataaacagagtaagagaaaatccttaccacttaaattcaccattttaaaaacacttttccgtcttctgcctttaatgagtgctcctcctcatgcctaactttatgggggaaacaagagttggggaaaataacttggatcttatcctaaattacaaaattgtcattcactcaatttcttccactttttaggcagagaataaactccattgtaatacttagaaggagaaaatgaaatttgtggcatttttattttaaataattagtcttactttgcttttttaaattagctcttcatgcagcacatgtagaattcagttcttatattcaccatgcagctttttcttcccatgaggaacgtggctcagtgaaaatggtgacttgatatttaaccgatccctttcagcctcctcttcctcatcgtatctctcatcctccacttcatcttccacatcactgctctgaggactggaggcctgagaccctgaaggagaaggtggtactgaggaaggcctgggatatttaaatccttctgtctgccaaagacaaaaataagacataaacatcacaacagtttcttggctttcaacgatgtaaatactatgcatgcactatcaattttttaagtagttatctatcttttgtagtctgggtgctattaaactttgattcattttgattttgataccaccaatctcaagagggattcattcaatatatagctattctttattaagtactgaaatgtgctaagtgttatatacatattattatcatcttatcttttaacaacactctgataaatatgtttttttcagtacagaagaaaatggagggttagaggggtcaagtaacttgcccaacatcactcagcacataaatggtagagcaaagatttgtaccaggtctgtgatgactccagaaactttaatgtcaactgccaccttacactgctgatactgttagtctctaagtctcaaatttgttcagcaaagcttttggatgtggatagcctggaaatgccatggatggccaccactagaaggcatcctggaagtcaggtcacttaattgactctacaattccactagttgctgttatttcagttaatgagaaaatatcactagactttaattaatttgcccttctacttgagatactgagataacttatttgataaacacacactgcaatgccactaaagaaaccagatgaaaaaacatgattggagtgcatataattgaatggggagacagatgtgtaaaagtgttatagcgctcgtcactctgtatttcaattactttatacattatatcatgtcatacatgtacagtcattttaaggttcagatactttacctgtcagcaatacaacaaaagaactgagttctgcacttgagacctagcttgaagtaggtgctcaatgcttattagacgtaataactggataaataagtagataagcagataaatggatgaatattgctgaattatcattaagtggaatgaccacctctgaataagctaagcaatcaactctgaatgctagaatcataaacatgaaagtcagaatttgtagcctgagggtttaagaaaaccttatcaccttttttacgggcaaattttacttcaggttaactttctagatctgttcctctggaaacctgatataggtggaatataagtcatgttattagggatggttgtttatggtaacagtgacccctgattgagaaattatatctgaactgaaaaatctataaatacttgataaggcgccagagtttttgggaatctctgaatgactcttataagatgactcataattgggcatattccttgcagggagcatgaaagctggtttgcggagatttacatgagatagaggctcctgtggggcatgcagctactaagctaaggtgatctcatttgcaatggtatgggtcttatcttcttgcacctaagctgtcacctagtgtgtaggcggccaaagatgtttagctcttggattgctgtgtagactactgcaaggactgatcccactaaagagaaatgcctgacgctcccctgcttcaagtggcacctcatgtcttctccctgctaagtgaatctgatgacaaatgtggcctatagcagtcttatgaacataaacgtctagttggattttagaagaagacaccctggtgggcactgatgaatggaccataaatgctcatctagttcaattcctcctggggtgctgaacttactctattttactcttgccaagcggtcaccctatatttaaacacttccttggagagcaaattcactttcaattaaagcagtccagtttgtttttgaacaactccccaaagaataaatgtccatcagaaccatttcaagcattaaggcagagaaagttttaattcagagatgcttctccaatgagatgaattaactgtcttgagagctttaggacagtctgatttgtgagttcctctctctctcctttggtttgattcaacattatgaaaaagtatcatagcttgtgtgcatagctacttccaaatttaaatgtattatttaaacttataaaaagaaatatagctttcaaaaaaaaatacattgaatatttaccgttggtggtgatgttagttccacatggaatttatctggaaaagctctgcttaatgtcaggtgtctggcatgctggtaatactattgatagaaagccaaatcacaggttaataaaaacccttagatatctcaataatcaagttattaaataaggccttattctcctagttctgaaacatatgtattttttaaagtgacagaatctatgcagtctaagtttgagactcaggaaagaaattacagtttatagttttactatttttcaacccataggcagagtaatactataaaatgctggggaagaatgcccatactggtcatattgagctctgaattgagcattaaggtgactgaaaacactggtttcattccacagagaagcagtgtggcatggagaaaagatagggcctgaatattcagataaattgggtgtaaatcctgcttcagaccttaggcaagaaacatcacttctaaaagcctagtgtatctatcttcattgcaagatggagatagtaaaattaatcatccaggttgtaatgagcactggcatttgtgtgtgcagatactcagcaaatggcagcatctctcattcagccaagagtgttcagcactgtgcaaacagacacattatgtgaaggcaaagtcaattcatttattattaaatcaccactgctaagctgtgtgagcatccaggtgtttataaacctattgcatgattgaaaggaggtatttcctgtagtcatcattttgaaaaaccatattatacccattactcactacagttgagaaatatgactacactatttctctagagagaaacaaagtagggacttttctcttgatgttttcttcaacttcataaaatgtttccttataccagtaacacatcaagtgaggcactgacaatggaatagctagtaagatcagtgctagatcctgatggacttgctattatgaatagactcaaacgaaacatgaagaaatacatataggactttgtaaacttattaaattttaaaaagtacatggagacactgagattttaacaattataatattggattaactttagagattatgactagaatcaatatgtttatagtccagtggaattttttaagtggtctgctgtgtttatctaaacttgcttactctgcctaagtatctccaatccagaagatctgagagcctctcagttctgttcctctggataatcctttggcggcgtgactgtttgcaaaatccatagagaaacttagtcagctgattgcaagaatcatctggagaacggaaccgcctgtcaacgatgtaaatacctgaagaacacaaaagccaaagcacaagtaaaagtaggactaaccttaaacatttgttctcctgtgatttactaactctttggttccatcaaaaacctatgcattatctaccccctgactcaggaattacccccactttattcttttctgaggccctaattcccttctaatggtttacaaccatcactgacacacagccaacgaagtggatcttgctgaaaaaaactctggcagtctagggatacgctggatcagtgatcctccatggggttgctcactaaccagaatttccagggcggggcctggatatctgtgccttttatgttccccagtgttcccactgttcagccgaggctgaaaaccccagatctagcctgaggaaagagccacagtacacccataaaagactgagggaaggccagggcttggtagctcacacctgtaatcccagcagtttgggaggcagaggtgggtggattccttgagcccaggagttcaagaccaacctgggcaacctggggaaatcccatctctacatacaaaatttagccaggtgtggtggtgtgcgcctgtagccccagctactcgggaggttggggcaggagaatcacctgagccagaaatgtggagactgcagtgagccaggatcaggccactgcactccagcctgggcaacagagtgagaccatgtttccaaaaaaaaaaaaaaaaaaaaaaacaaaaaacccagggaaatggcaatgtattggcagacaatatatcccattttaacttttcttgctgctagggaatatgaacagacagataatggtatgcaaattattctgccatcttaaacaatttaggtgaactttgctaagttgtcacgggcctttaaaataataacagtaatgataacaataataataatatatgtactatctaatgaccaatatatgcactctaagaccatggttattgtcatatcatttctaggcagcagaagggatcaaaattcagggaggaaaaaggtaaaggacaaagtttgtccaagttttgcactctttttgcagtttgtctcatgggcaatatattaatattaatagcattcttatgttatctgtgggccacatatttaaagctacttttttttctccacttttagtttaggttcagggggtacatgtgcacatttgttagatgggtacatttcatactgctgaggcttggtgtacaaatgatcccatcgcccaggtgattaacatagtgcctggtaggtagtctttcaacccacgccccttcccccactccccactcaagcagtccccagatgtctattgttcccatctttgtgtctatgtgtattcaatgtttagctcccacttataagtgggaacatgcagtatttggttatctgttcccgcattaattcacttaagataatgacctccagctgcgtccatgttgctgcaaaggacagaattctatttataaatctactttttttttttatgagacagcctgaggctctgtcacccaggcaggtgtgcagtggcacgatctcagctcactgcctcctccgcctcccaggttcaagtgattatagtgcctcagcctctggagtagctggaattacaggcgtgcaccaccatacttggctaatttttttgtatttttagtagagatgggattttgccgtgttggccatgctggtctcgaacccctgacctcaagtgatccacccacctcggcctcccaaagtgctgggattacaggcatgagccactgtgcccagcctaaattgacttttaattaaacaagaaatataaaaacattagtttaattatcaggatagctttagagttaggctctgtaaagaccctgtgctttgtttggttagaggtcatgtctccccagcatgggttaatgatgaaaaccctcaccgtaagcagtaggatcagccacgtgctcctgcatgaaacagccaaacccggagagattcgtggtcacactggggatacccatcacagtgcattcagctgccaggggaaatagaccaaagcttggcttcagaccagcgcctatatccttgtatgcactcagaggaggaaaaggccctagtcctcctaagaatagcaatgttcactatgtgtcagtcacaacactaaactctttacatgtctcactaacttatttaatctctcaacaaccctgtgaagtggggccatcattatccccatcttacagctgaagaaatgaggcacagagaaattaataactttcccaccttcacaaagccagggttcgtggtatagctgggatttgaagtcaggcacccggctgcagaacccttgtgcggaactgccgggctccactgcagcttcaatcccagctggttttgtttcttgcttctttctagcctgtgtttctaagtacttggcaagtttatgaggtaggttaaatatgttttggatgcgaccagcttcttcccccatttaaatctcccttggcacatattccttccactctctcaggagctcaataaatggatgatctcttgcagtcctccctcaccttttaatcaaaatctgttttccaggaaataactgatatgtcttaaaaattttactagtctcaaggatgtctacatttttaggaatttatatttgataatggaattacccttggttggtgagtggagttggatgaaaaaaagatcttcccattacccatgaagtaatacaatctagacagcaaccttatctcttgctctgcaaatgtttcctcttggtttagctgtatagctgtggagttgtggttctctaattttagtggtgggtggtgcagaggaggaaagtgggatggggactatcagcccttttgagagtctgatgaacattttggaactcctctccagaaatattcttctttttttaatttttacacacttttatttcctcagacttcctcctggactcagctccaccttctatgggagttgggagttggagagtatctcttattttcttttttaaaaaattttactttaagtctgggacacatgtgctgaacgtgcaggttcgttacataggtatacatgtgctatggtggtttgctgcacctatcaacccatcgtctaggttttaagccctgcatgcattaggtatttgtcctaatgctctccctcacctcgccccacaacccgacaggccccgatgtgtgatgttcccctccctgtgtccatgtgttctcattgttcaactcccacttatgagtgagaacatgcggtgtttggttttctgttcctgtgttagtttgctgaggatgatgaagagaaatattcttatacacatatgtatacaaaattttgtctacaatgccgtgaaagttcacagatccttcatgtttattaaatggccatcaattcactatgtagtaatattccaggcacccatgaagtttagtatatgttcattgaattaatttaatgaaataaatgcttatatttatttggctctctgaaaacacatttggatgaatgctttctagagtgagttaagtctagtaacacgtaaaaagattattctaaaaacattagcaagttatctaatatgctaatgttaaatgtataccaccagaagtcgcattcttcctgtaactataggttaggggaagagtgaccagctccctttggttaatgtaaaacacagcatgactcattcactatggactattccacaaactcccttatttgtctatttataatatcctttgtaacatcttctttggcctttatcttaaaacagtagatatatctcctctatcattttgggttgttaagtttaactttgccctataaaatgacactttggtggacagtcagctgttagttctataacattttcttgacccgacagaaaggacttcccacattgcctcagtcactcatgcatttggttgtatactcttctatccatgatacttccaatagtaaattgttttactagaaataataagaacaaggtcaaaaacaaagtgttaagttcatcagtgaaacgtgtgctttatgtatctcaaaagatagtgcattgcaagcaatttgagatatttatgtggacatttcctaagtaagaagacaccaccttcacaaaagtaggccacttttagatctgcaagagagatacccggaagagttagatacaaatatttcctatgtcatgtttcaagacaatcctttgtctattttccccaagaaattttaaagtttttatagctgctggcaaattatgcttggtgaagctagaacaatagaataggaccttatgaccaaacatgcccagccctcatgttgttcctgctgtaaataatacaggatcctatttttgtagacttttaaattctgtattttaattctaggataaagatgcaaataatagaaaaaattcttcctcttcataattcagcctattattccctctcaccttggcctctgctgctccttacttgagctttatatcaatgataacattgagatacaaaaggcaacatttactatctcaattataaataaaaatgttttctgaactttttaaaagtcacaagtgaagaggccgggtgtgatggctcacgtctataatcccaccactttggggagccaaggcaggtggatcagttgaggccaacagtttgagaccagcctggccaacatgatgaaacctgtctctactaaaaacacaaaaattagccaggcgtggtggtgtgtgcctgtaatcccagctactcaagaggctgaggcacgagaatctcttgaacccaggaggcgaaggttgcagtgagccaagatcatgccactgcactccagcctgggtgacagagtgagactccgtctcaaagaaataataataaaatcacaagtgaaactttatttacattgggcagaaaaatatctgattattaataagagatggaaaagttattgttgtattctttgcattggcatgtatttaaagtatttgtttcccttttaattagacatttcagtacaagtacaaattggtcgctcttgatgctaatggcaaccatgccagttcggtccagaaaagaaaaatacatagtaaacctgagaaactaccatctgttaaaaaataaaataaaataaaataacaaaggagggtgaagaaggaggagtttctgaatggaatgatgtcattgttgacaataccactgaattgctaatctctcttagtaccttttattttgaggcacaagaatgtgaagaagacttttcactgtacacctttttatatttatttccctaaccatatgactgtgttacccattacatattaaatatgttcattaaattttaaaaagaattattctaaaataatttttaaagaacaacattgctagactattatttattatattaatcctacttacagtcaatttctccttcacactaataaatggggcagatagagatagctaaataagatacaacctttatatcacattcctttttctttggaattcaatgaggcaatacctcacatacctcctaaaatatgcccaaaccgtggtatacttatataatcttcatccttattcttaagtaattatctacaaatcataaattaatccctgtgataaatccaaccaaaattttttaaaactgaagaattgaaatcttattagaaatttaatatcaactttgaatattatatatatgcacataaaataatatactaacaaaattcaaaacattccacactctatacatgacacatacctggagtataaccccagggttcatagtatgatggaaatactccaagatgacaacctc

SEQ ID NO: 13032 - DNA, 538 bp, Homo sapiens
gacaatggaatattatttagtgctaaaaagaaatgagctatcaagccatgaaaataaatagaggaaacataaatgcatactactaagtgaaagaagctcatctgaaaatactacatgatgtatgatttcaactgtgtgacaatcttgaaaaagttaaactatggaaccagtgaaaagatctgtggtttccaggcgtcaggggtgagggagggatgagtgggcagagtatagacaatttttagggcagtgaaactattctgtatcatactatgatgatgaatacatttgtcaaaacccatagaatgtataacaccaagagtgaatcctaatgtaaactatggatcttgggtggtaattatgtgccaatgtaggttcatctactggaacaaatataccactttgggggatgctgataatgggggagtctatgcatgggaagggccagagagcaaatggacactgtactttctgttcaatttttctgtgaacctaaaactgttctaaaaagcaaactctattaaaagtggatatatacaat

SEQ ID NO: 13033 - DNA, 538 bp, Homo sapiens; identical to SEQ ID NO: 13032

SEQ ID NO: 13034 - DNA, 6638 bp, Homo sapiens
agccagagagtaagtgctgaatgtgacgcagaatcatgttaggtaacaaggactttgaggtaagtggctgaagtcttctgtggagtcagccgactcttgcaggattgtgtggtatcagtcacctttagcatttgccaacccaactctgatcattcttcttctttcaaggtatctcagcgtttgagtcagccaggagtagcaataggtttggcttggactcccttaggtggagaaatcatgttcgtggaggcgagtcgaatggatggcgagggccagttaactctgaccggccagctcggggacgtgatgaaggagtccgcccacctcgctatcagctggctccgcagcaacgcaaagaagtaccagctgaccaatggtaggagcctgcacccggccaggcaggcgtgacccaggaggcggtaccttccatggcggagactggcatgagctcgagactgccagttacacatctagcaaagtacacaccgttttgaacccctgtggaaatcctagttcccatttcaggactatttgactagtgcctgaactagaaactaattcaaaaggtttattttgttttaatacgacttagagtagaatggaactgttcttccacaccctcacccaaattgtactgtccaccaatattttgaagaattcatttacccaaaacattcatttttgtttgtgactttttttttaggagaaaaagaaaacaggtttaatttttctacattaaagtccctttttcctttttaaagcttttggaagttttgatcttcttgacaacacagacatccatctgcacttcccagctggagctgtcacaaaagatggaccatctgctggagttaccatagtaacctgtctcgcctcactttttagtgggcggctggtacgttcagatgtagccatgactggagaaattacactgagaggtcttgttcttccagtaagtatgaaaaaacaatttatatggttattttttatttaatttttgaaaattaatattatttttaaatacgggtttgccttctttctatgaaaaccttggttttaagtatatattatatttttatgcctgtaactaattcatattttaaaattttgatcaaataaaagaaaaactgacaatttttcacattttcctttttttttttttttttttttgaaatagacaggtctcactctgttgcccaggctggagtgcagtggtgtgactgtagctcactatagccaccaagtcctgggctcaagcgatcctcctgtctatctcccgaatagctgggactataggagcacgccaccatgctcagctaatttattttattttgcgtagagacagggtctctctgtgttgtccaggcttgtctcaaactccaggtctcatgcagtcctctcatctccacctcccaaagtgctgggattacaggcgtgagccaccacattcagcccacgtttcccattctaagatttgctaagggaaaaaaatattagtgtggtcatcagaaatattggcagttacatgaaaatttgaggccttgttctacttgacaaattgttaaagatatagcacatgtgcaaaatgggatagtagttgtttttaagctttaagcccatttcttaaatttgaagtttctttgagacctcctgtccccctgcagaaaactttgctagtatagaatggaaactctaataaagattaaccatatctaatgactacattttgaaaaggttctatacatgtggggtcttgaggctccagatcctaaactgcttataaaaatagtgtgataaaatgtacagaacttgagagtatttaaagttgttagttgagtattagtctacaacagactagactacaattttagtccacaacaagattttggcaggttcatagcaagatgaggaaaaaaaaaaagaaatagtctttttttcttttttctatcgagatggagtccggctctcttacccaggttggagtacagtggcacaatcttggctcactgcaacctctgcctcccaagttgaagtgattctcctgcctcagtctctcaactagctgggattacaagcatgcgccaccacgcccggataattttttctatttttagaacctccatagaacaaatgggttttctacttggtcccctctcagagcaaatcgtagcccaagtaaaggcttctgcagcctcaggagagacagccacagcggcctggggtacaccttcagctccagaccattacaagaggcaggatggaaagcagcagcacttgaaagaaaggcctgtgaaagctggagaaaacctcctttgagaacagaggacaagacggggctttgggatttgaaagtggtcaaagaattattcaggaaaaaactatagtgaaaaacaatttgttgttagaactccaacatctaaaaggagttctaacaaacaggaaaatggaatggaacaaattatccaagaaataactgaacatttcctagaagttaaggcatcttgagatcgaaaggaccattactaaccaggaaaaacatttcatccccttgacttttcagattactgaggataaagcggcctcagcactgacactggatgtgcagtaccttcaaaactatgagggaaaatgggccaggcgtggcagctgacgtctgtaatcccagcactttgggaggctaaacaggaggatagctcaagtccaggagttcaagaccagcctgggaaatatatctctacaaaaattgttttaaaaatagtaaggaggctgggtgtggtggctcacgcctgtaactccaacactttgggaggccaaggtgggcgtatcacttgaggttaggagtttgagaccagcctggccaacatggtgaaaccctgtctctactaaaaatacaaaaaaattatccggatgtggtggcgcatgcctgtaatcccagctactcaggaggctgaggcaggagaatcgcttgaacctgggaggcagaaagttgcagtgagccaagattgtgccactgcactctagcttgggtgacagagtaagactgtctcaaaaaaaaaaaaaatagtaatgaaagctgtgagggaaaatgttttacatctagtcttgtatacatggccttagtatcaatcaagtgtgaaagtaaaatattttcaaacatgcaaggaatcagttcatcttacactcttttgaagaaggtactttgaaggagtacttcagcagcatgaacaaaaccttgaaagaagatgccagtggggcgggaaggcctggagcagccagccagtcttaattggagcagatgcaacacattaccccaaagcaagaatactccatactcttcaagttcctgtgggccaggaattcaggagaggctgagctgggttcttgtggcccagggtctctggccttacagtctaggttccagccaggctgcagtcacatgaaggctgacaggctggagaaactgcttccatggtggttgactcatgtgactggcaaattggtcccatctagtggcaggaggccccagttcctcacctgatggacttgcccataggctgcttgagtgacctcagacattatgactggccacctccagggcaggtgatcaagagagattcaggcagcagctctcgttttttgtgactcagccgtggagatcatacagcatcactcccaccacactctgtttcttaccgagtcacaaagcctggcccacattcaagcagggggaccattgtagacatgtttgaaagccaccataggagcctagtttagggatacattttcttcattaaccagcatggaggttctggctttaaacctgtagagagggaagtaaccccagcacacagctaagctctgcaggagcggcgctcatggtcagaatcacgtgctgctttttcagatcaacctaaagactagacggttgtgattacacctgaatgccaatttactttgacagcatttataaaaacaatcattgacagaagaggaactcatacctatcaacaatttagaatccccctcatcagagtctttaatataacaccaattgaaacattaaaaaaaggttactacttatcctttttcctggctttcctagctcatgctataacaaaacggaagatgatttggatgttttaaaatagtagtggttaaattcagtgaaagaaagctgggtcagggtttctttcagcttgagggtgatcattaaccctaaaaacttttttctctccttacaggtgggtggaattaaagacaaagtgctggcggcacacagagcgggactgaagcaagtcattattcctcggagaaatgaaaaagaccttgagggaatcccaggcaacgtacgacaggatttaagttttgtcacagcaagctgcctggatgaggttcttaatgcagcttttgatggtggctttactgtcaagaccagacctggtctgttaaatagcaaactgtaggtccaaatctcaattttttagaattttaagttatgaagtgctcaaaggtactgacacagttgattttattcacaccattaggggtatgcaagatgtccctgttttataaacataatcacaacagtaataaacctcaagtagtggctagtgtttagtatagaaatataagatgttgatttagtaaactgataaaaatcgaattcttgtctttttagtgggatccttactgtccctggaaagatatagcatagtggttctcagcacagtctccagaacagaagcatctgtagtacctggtaacttgttagaaatgtacattctcaggctccacagcaggccgcctgaatcaaatcctgggaggtggggacagaaatctgtgttttaagaagccttccaggtaattctgctgcacactcaagttcaggaaccaccggtatagaccattaccttagtggatttacctgtagagtttattggatcctgaaaccaatcaattacttagaactaggcaaagatgaaagtatagccaactattcttggctatatatatatattcaagtgggccgggcgtgatggctcacacctgtaattccagcactttgggaggtcgaggtaggcagatcaccgagcccaagagttcaagacaatcctggccaacggcgaaactctgtctctacaaaaaatatacaggcgtgttagcatgtgcctgtaatcccagcttcttgggaagctgaggcacaagaattgcctgaacccaggaggtggaggttgcagtgagctgggatcgcgccattgcactccagcctggctgacagagcgagactgtctctaaaaaaaaaagactcaagtggaccctacaatgaagcctacacatcccaatagaagccccttcttatgctgagggaagcagccctcagaacatgatagcttgtatccagcagagtggcacgtgctggcacacctcacagaagcaccctggccctggatgcctgcaacctcagaagagtgcagctcccagagggaggcagccatccatctgggatggtcctaagcatggaatcctaactcctgattccgtctcctatttcttgcttggctacgccagttcccaaatctggtagatgtccatgcccatgtgctcctgctgggactcaattcaggctatgtatgactatgaagtcaggctcatctgcttactggctgtgtgaactttttgtatcttggttttcttcatccatgaaatccaagtaatactacctaattgttactgtggagattaagttcaaatgcaatgtatagtaatattaagcaatttctagttattattctagccagtaatggacttcagaatcttttattacacaatataagaatatgtatgtaaagacattttggaatttcctggatgagaaggaagtctgggctgggcatggtggctcacccctgtaaccctagcactttaggaaatcgaggcgagtggatcacttaagctcaggagttcaaggccagcctgggcaacatggcaaaaccccatttctacaaaaaatacaaaaattagctgggcatggtggcacccgcctgtagtccagctacttgaggctgagatgggaggatgagggaggtcggggctgcagtgagccaagatcacgccactgcactccagcaccctgggcgacagagtgagaccctgtctcaaaaaaaaaaaaaaaaaaaaagattgggccaaaatactgtgataaaatagcaggcctgctgataaaagtttatctgaatgcattgagaggaaaagtccagacctaggactagttatggcagttggagagaaagaacatcgggatgtttgaaaatatgccattgactatcttaactactgtaattttatcatttccaacgtcatctaactggggactagaacaaactgtgaattcactttcagcaaccagagggcgctaatccacacccacatcgctctgccctgttccacccagcaggggcaacaaggatataacttggggttctcggtattcttcctttagtcctgacacaggcagccttgcactttgtagcagcaggagggcacttgctttaagcatatctttcgaaaggcatccattgagagaataatgcattctccccttgctgtgtatgacatggaacagtatgaccattgcacta

SEQ ID NO: 13035 - DNA, 84 bp, Homo sapiens
taatcccagcactttgggaggctgaggcaggcagatcacttgaggtcaggagtttgagaccagtctggccaacatggtgagacc

SEQ ID NO: 13036 - DNA, 5455 bp, Homo sapiens
gttgggggctgggtcatggctgctcccaggccccacccaggctcctgagcctagaaggtgaaaagaggactctcaggggctcacaggggctctcactgctggttggccctgccctcccttccccctcagcagggtgcccggaagctggaaccttgttatctgggtaattagtttcagaccctgcactgaggccggccaggtctcggggctgcctcccataggttgtgcaccctgaccccgagagggaggcgaggcgctgcttgtcgacagctagaggctggcctggggagcaggtttggggtgccctcccacactgccctccctgccccggcccatgccccccagggctgcctgggcctggttattgtgtggggcctcctgacccagccaagggcacgaagctctgggaaggggatgcccccgagggtgccagtccagctagctgccccacccctcaggcccagcctggcccccaagctccccactctggtgccccgagcagccctgtgggcaagcagccgccgccatggccgagcacctggagctgctggcagagatgcccatggtgggcaggatgagcacacaggagcggctgaagcatgcccagaagcggcgcgcccagcaggtgaagatgtgggcccaggctgagaaggaggcccagggcaagaagggtcctggggagcgtccccggaaggaggcagccagccaagggctcctgaagcaggtcctcttccctcccagtgttgtccttctggaggccgctgcccgaaatgacctggaagaaggtgagtgtggctgagcccagagcagctcccagcagacggcccactccctgctacctgggtgccgtctcatgccaaggctgggggctgggcctgtccacagctcctgggctccagcccccagatcttgcctggtctcttcaggctgggtggcccagggtgcccccatcaggcaagccccaagcagtgggcagccctgaggtgagcctgtgcgggacagccgtccttcaggcgggggctgcatgcagagggctcctgctgtgaggtgagctgaggccatgagtggacccccaggagcctgcagaaaaacctagtgcggggccccacgggagcaggggtggccggtagtcattgctgcttcttgttaggctgctcaggagagccctggtctccacctccgtgaaatagggtgggaccagccacctctgtgggtgagagagccaggccctgggcaggcacagagctatgcaggtggccccctctcagtgcctgccctaggctctgcttgtgactctcttctcctcacctgtgccccacgcttgcagccccagctgtgtgggttccacttctggtgctctggagtctggggggaagaggcactgtggtggcccttgagactccttcctgcctccctccggagcagagagtaaagaggagccggcagtgtctggcctgcatctttccatgtggacaggagccctcccgggaggcctggaggcagagggaagaggcggagggtgccatggtccacagggagctgtgggaaggtgggagccctcctgctgcaccccaggcaccgtcagggagaaccctggtgacctgggcgagagctgggcccgagttgggatctttgatggggaggggagtgagagcagggatgtgctctggtggtggggagcctcaggtcaggtcccagaggacccaggagagctcatgaacacagggctggcaggttgtcagggaagagccgaaggagctgtggtagcctccaggcagggagctcttcctgggctggagggaggtgtgggattgttggagtgctgctctcacacaggagcacggcctgttctgggggtcggagggctggagcaccaccatgaagggcctgcaggtgggtggaggcagagggcttctgggagtgtgaccggcctgggccagacagatgcctggtgcttctgcccccacccctgggctctggtgtgcctcctgccatcggcaccactgtcttccttgtccttccctgggtcctgggccgaagcacagttgacaggacctgaccaggggcaggaccctgtcctcacctcgccacctttttgcagtccgccagttccttgggagtggggtcagccctgacttggccaacgaggacggcctgacggccctgcaccaggtcagcctgcactgggtgtgggcagggtgggggctggcccccgtgctctggtcgctcacgtggcacggtttgcagtgctgcattgatgatttccgagagatggtgcagcagctcctggaggctggggccaacatcaatgcctgtgacagtgagtgctggacgcctctgcatgctgcggccacctgcggccacctgcacctggtggagctgctcatcgccaggtagggcctgttgggcgtccttggcagggagaggcttcctctcagatggccgctcaggaggctcctcttgggcagtatctgtggctctcggcctcctgtgttcccgccttcacctttgctgaccctgcctgtgtcctggcatggagagcagggcctggggctccaggggaatgggcatgtgcccagggcagcgcggtccctgcctccccagcattcgtcctcctgccgagagggcaggcctcgggcccccccccagagtgtgcacagagaaatgtcttggtcagtgaggagggcagaactgctaaggagggaagcagagtgaggaggccaggtggcttgggaggagagggtacctgagcacaggtagggcctttacctttaacacagagggacgtagagcggggggaactctgagcagggagggtccatgagcctcctcccttcccctttgctccaggcatctgtagtgggagagaggtcagggctgcggtcattctcgagtgcccctgtgaggccgggtggggtgtggatggcggtcgcgtcacacacaggcgctgcggggcaggcggggatgtggggtgtccacaggtaggcctgctcctccactgcacacagacacccccttctgtgttctgggctccccttcaccgccccttcttccctggggccatgctccccacagctcagcagcccctcagcgtggctgcctggtcctgcacccccgccaccctgtgctccctgctccccagcaggcaggcccatccaatgcatgtttatgggggcaccgctgcccctggaggtgccaggaacctggatccctggatggatagagactgcaggaggcctgtctggcttaatgacaggatctaggacagccgatgggccccaaggctgcctctcccagcagcaggtggacagggtgcctcctgaggggcagccctgggctgaggggccctggcggggacttctccaagtgaggagcctggcaagcggggaagggccttgtgcccagcaccccgtccgtcttccctgcagtggcgccaatctcctggcggtcaacaccgacgggaacatgccctatgacctgtgtgatgatgagcagacgctggactgcctggagactgccatggccgaccgtggtaggtgcggcggtgcggctgtgggagggctgccggtcgcgctccctctgagcctgccgcctcgcaggcatcacccaggacagcatcgaggccgcccgggccgtgccagaactgcgcatgctggacgacatccggagccggctgcaggccggggcagacctccatgcccccctggaccacggggccacgctggtgagggctggggggtgaggggcacacggggctgggggcctcgctacttggaggtgggggatggggccgaattcaggccgggcgcttgcctgcagctgcacgtcgcagccgccaacgggttcagcgaggcggctgccctgctgctggaacaccgagccagcctgagcgctaaggaccaagacggttgggagccgctgcacgccgcggcctactggggccaggtgagtgcgggcgggagcaggtgggagggggcttccagcgcagcagtctgcagctccggcctgccgtccacaggtgcccctggtggagctgctcgtggcgcacggtgccgacctgaacgcaaagtccctgatggacgagacgccccttggtgagcttgcggagcccacctccacctgggggagaggacaggcggagagggcgcccctgacgcctgcgcccacttctcagatgtgtgcggggacgaggaggtgcgggccaagctgctggagctgaagcacaagcacgacgccctcctgcgcgcccagagccgccagcgctccttgctgcgccgccgcacctccagcgccggcagccgcgggtgagcgccgcccccagcaggccccgccccgggcttggccccgcggacgtcagccccgggcggagtgccagccgaactgggggcagagtccgagggggtgggcggggtcctccgggcactccccttcccctcactccctctcctctctcctccccaggaaggtggtgaggcgggtgagcctaacccagcgcaccgacctgtaccgcaagcagcacgcccaggaggccatcgtgtggcaacagccgccgcccaccagcccggagccgcccgaggacaacgatgaccgccagacaggcgcagagctcaggccgccgcccccggaggtgagcgccccgtccctgctccgcccagcgcaggggtgggcctggctctgccctggttctctctccgcttggaccccctcctgcctgtgtcaggaatggtgccctgcaggggccagcttttgccccatctctcctgtctgtcccttcatgaccatacagcctgaacccaaggccagggaggggggaggagcctcctgatggctctgggaccttcactgcccgcaggaggacaaccccgaagtggtcaggccgcacaatggccgagtagggggctccccagtgcggcatctatactccaagcgactagaccggagtgtctcctaccagctgagccccctggacagcaccaccccccacaccctggtccacgacaaggcccaccacaccctggctgacctgaagcgccagcgagctgctgccaagctgcagcgacccccacctgaggggcccgagagccctgagacagctgagcctggcctgcctggtgacacggtgaccccccagcctgactgtggcttcagggcaggcggggacccacccctgctcaagctcacagccccggcggtggaggctcccgtggagaggaggccgtgctgcctgctcatgtgaggctgttgctcagcatgcaggggccctgtctcgggcacagcccaaggctgcctccccacggtgcgtgccctggtgctgcgggtgcagcacggaaaccccggcttctactgtacaggacactggcccctctcaggtcagaagacatgcctggagggatgtctggctgcaaagactatttttatcctgcaactcttgataaagggctgttttgccatggag

SEQ ID NO: 13037 - DNA, 427 bp, Homo sapiens
cctccctggttcacgccattctcctgcctcagcctcccgagtagctgggactacaggcacgtgccaccacgcccagctattttttttgtatttttagcagagatggggtttcaccctgttagctaggatggtctcgatctcctgacctcgtgatccacccgccttggcctcccaaagtgctgggattacaggcctgagccaccgcgcctggccaagcacagagtgccttctgaggtgaggcctgtggccagcccagcaaccacacttagtgtgtcgggcaggactagggccatagcaggtacataggcagggttgtgccccagccgaagctgtctgcctgcctgtctgtccccataggcctcaagccaggcaccaggtgggggcttttattgcagcctaggatggcagaggcattgtgggagcccat

SEQ ID NO: 13038 - DNA, 10751 bp, Homo sapiens
ttacagaaagagagattctatgaaagccggtgcaggccagtgacaccatcatgtaaggagctggctgacctcatgacccgctgcatgaactatgaccccaatcagaggcctttcttccgagccatcatgagagacattaataagcttgaagagcagagtaagacctgccatgtgctgctttaacccagcttggggagaaacaggagcctgggtggcaatccctggcaatcgactgcctttcactctgttttcttttctcttctgttagatccagatattgtttcagaaaaaaaaccagcaactgaagtggaccccacacattttgaaaagcgcttcctaaagaggatccgtgacttgggagaggtaagttacacccgtgctgcttgctgctgatggcagagccctccgccatccacagcgccactctctgcacgtacagctgctctccattctttttcattctggggccaggtccatgagcgaaagcaccttactgcatttgggggccactttcatcacaagggattgtgtctttctccatgtgacacacggcacggacggaatgcacgtccctgcctgcatgcacgactgtgtatgcacacgggactctgggcagctcccttgagagacttgagttttctctacaggacagaagagaatggaaagagggagagatgggggagtaggtatagatatggtggaataggaaaatccttgcctctgactttcccgggcatatatatcctgtaagcttctctctttttcttttgcccccgagagacagggtctcgctctgtgtcccaggctggagtgagtggtgtgatcatagctcactgcagcctcaacttcccaggctcaagcaatcttcctgcctcagcctcctgagtagctggaactacaggcacacgcccccatgctggctaatattttttattttttattgtagaaatggggtcttgctatgttgactaggctgctctcagactcctggcctcaagcaaggaggcctcccaaagtgctgggattataggcataagccaccatacccagccctgtaaggctctttagagcagggataggtttattgcacagaatcccaaaatagagtgtcagcgtttctttggaccttaaatgggagtttccaaacagttaattgtgactagagaagctactgagatttgtgtctttatacagattttctgtagtctggttaatgaaacagacttgatacatctccaggatctgctgtgtgccagccactgtgccaggcattgtcagaagcatggcatccttagttccccccaccgtccccgaggccagtttctgtatgcagcgagtgcatcaggagccagctccgatttggggacttggccaccactgtcgctgtcaggtggcttggctggaacctgatctcacgtcttctaaagactcctcatgcatttgctcttttcagccatgctgtggggcctgtcctgtaacgtgagcccagggcttttagagaacggcagttgtcctgcaggcccagaaataaccttcatttcctgtggtcatagaaattgggattgatgagttggttcatcgtcacctgctactttgtcttggctcagtaactgaggggacagtttgtgaggccaagagagcgagggggctgtagtgagcaagtacagtccaggtgagaggcttctgcctgcaaggccagacagcgagaacccctggccctcaggggaacggctgtgaggagcaagacttctgtgtgttccgtggcctacgatggggcttccctgataacagcacatgcatctttccctccagggccactttgggaaggttgagctctgcaggtatgaccccgaaggggacaatacaggggagcaggtggctgttaaatctctgaagcctgagagtggaggtaaccacatagctgatctgaaaaaggaaatcgagatcttaaggaacctctatcatgagaacattgtgaagtacaaaggaatctgcacagaagacggtatgttatgcaaggctggggtccggtttaaagatttggtgactgtctagggtcataaaggccagtgcaaaacaggcactccgtggccttacctgggcgtctgacatgctagctggtggttcccacacactctcaaggcttccaagtcatatgtcaaatccctcagcagctgcagggctcctgaggaggccacccaggcccctccatccaggggctggttccagcactgtctctccacgtcacttgcacttatgccttatgaaactgattcctactctacctccacccacttcctgttctgatccaatactagccagggtatttcattttctagttgtctaaatcaaagtggcaagtaatatttactaataattgtatcttatttgcaagccagcatctactcatggtagtgaaattgacagctgatgataatttttttttttttttttttttttttgagacggagtctcgctctgtggcccaggctggactgcagtggcgcaatctcggctcactgcaagctccgcctcccgggttcacgccattctcctgcctcagcctcccgagtagctgggactacaggcgcccgccatcacgcccggctaatttttttgtatttttagtagagacggggtttcaccgtgttagccaggatggtctcgatctcctgacctcgtgatccgcccgcctcggcctcccaaagtgctgggattacaagcgtgagccaccgcgcccagcccgataatttttgaaaacagtcatttgcctgtggtttacagagcactctgactgttatctcagtgagtgcttatgcctgtgaggtaggtacaccattgttaccatctccattcactgctgaggatcttgaggcataagaggtcaagtaacatgcctgtaatgaaggggcgaagctggcgtcacctcagggcctctgtctcatatcctgtgcccttgcctctcccatggttccctcatttggcagcctcagactgatggatgttttttctaaacaggaggaaatggtattaagctcatcatggaatttctgccttcgggaagccttaaggaatatcttccaaagaataagaacaaaataaacctcaaacagcagctaaaatatgccgttcagatttgtaaggtaaaaaataaagacatcatgttacagattaagacatcaggcactctgtcctgggtaattggtttgtaatttgactctaagtgggtaagtttatgataattatactgtttgtttttctctgcattatttagatgaaaagttagcttctactaagaaagtaaacggatttaaatatggttattttaatgtgtatttatttgaatcagtttgttcttaatattcttgcataaaagtcagaaccaaaaaaattgtcagtgatatgtgaatgaaatgacatttctattttttctgatgaagtgatagataatacaatctaaagtgactttagcaatgtgcttgacttttacttctctctctcaggggatggactatttgggttctcggcaatacgttcaccgggacttggcagcaagaaatgtccttgttgagagtgaacaccaagtgaaaattggagacttcggtttaaccaaagcaattgaaaccgataaggagtattacaccgtcaaggatgaccgggacagccctgtgttttggtaactgaatcaaaccactaggttttatcaatgcttcatagagtttacactgttttaataggccctttctggctatattaatgtgtctcattcctctggcctgactcaaggttagagaaggtttagaacatttggaattgattgatatttatcttcaagaaacacacctttcagcctgtttcattgaaagcagcctatataaatgactgagcttcatatgacaccgtcttccaaggaatgaaagaaatctaaccaccagctcaacattcctagctttccaggagagggcattcatctgatgcagttcttaaaactgtgagcaggtggagagaatctagttcctttcttaaacacattcctgcagagggaggctgtaggacagagtgggcattgcagattcagggaactcctggacagagcagagcaaaacctacgggagacctggctgtctcatgaatcaccagaggttcccaggttagaaggccacacactggctacaaccatgtctcagccgggaacactgtccaggggagaggctgcttacatctctaccgcaccctgccacgtaaccacataacgacataaccaatcagcactcccctaggtgcatcctacatggacacaaacatagacctctcccacttatggagcctaaacttactcattcattcatttaagaaaatgcatcaaggtcctgctttgtgccagtactggagatatggtgaacaagtaggccgagtttagagtttaacaggctaggcagccaacggcatggagcaggaaacatacagaagggttcgggcttggttttctggaagtcgtgagtattcagaagaaacctgaaagattcatgcgggtttagacagacggttgctagacagcatgcgtgactaggaagaatgagacaagagcagtcgatttcccaggaactgaacctcagtgaggtcagatcatggaataggaggtttgcaggaggaagcttgagtcatggagctgggacttcatctcaagaacaatgggatgctgctggagagtttaaggagggagactttgttttaaaaagaccaccactgaatgaagggaacaagattggagccagggagtctggagccagggagtctggagccagggagtctgatttggctgcttcaacagctcaggccagagctagtgacagcatgaattaggacagggactgggagagtgacagtagggtttgagagaagtgagtaggttcaaggagtatataaggagattgggtgcggtggaatgccttcatttttggcttgggcaagtgggtgtcattcagcaaagtaggcaatgctggaagaggattggacagcgatgccacattgtgcagtgaggccactgctgtctcatttagagcctgcaggcaaatcagacctggggctcatcattacacggccacctcctcccataccctgagagcatgttctcagtgaaatgaagagcacagacttggcgtgttattttagggcagatacgtgctaccgagagcctgtaaaggataccgtactataggtcagatgtgcaccatagcagcgtatacatggtatgtgtaaaatatataatacacagtcagatgctgtattaaattataagaaaaaccgaagaggtgatttttcagttatcctgtaatgtcggatggagtgtgcctcccaggaaatgaagttttgtgttctgcttcctttcaaggtatgctccagaatgtttaatgcaatctaaattttatattgcctctgacgtctggtcttttggagtcactctgcatgagctgctgacttactgtgattcagattctagtcccatggctgtaagtcctacttttctcttcatttgaatccagtacccatttaaaatgtgtccatccctctgcttggttaacttttgtttttaaatggaatccaatgaatgtattataatggaaaatgtcactttcccattaacttggtttgctacttgacagttatttgtgaatctctaaagtcttgctttcacaacgagcccggagttctataggatgaccttgactctcaaggatcttatctgtgtagagatgaagggcagttttatgggaaaatgagcaagttaagtggggtagcactgggtagggaccagccttgtctgtgcctccttcattcctaaatcagatcattttcttgggaacagactccttgaccagcacaagcacaaggagtggttggtagagtctaagacactggttagagacagatcattgaaagctaataaggattttggatttttatttaaagttactaaggagaaaagcctttttattgctacttaaatttccagttgattgtagaaatttcaccttaatctgtttggcatttatgtaaatacttgcaaagttaaacgttttgtttgattttattttatatagttgttcctgaaaatgataggcccaacccatggccagatgacagtcacaagacttgtgaatacgttaaaagaaggaaaacgcctgccgtgcccacctaactgtccagatgaggtatctatgggccacgtcacagtaataacactccatttctattatgttttcgcagcttgagttgtccagcaatgggtagaggggagagcgaggaaatgatgcagtgaagtccttgtaaaatagttttctgaagctgaatttcacataagataactgagaaatcgcctttggggctagatgatagccaccagttaggttcagagcaaggattccctccaaaagccagcccctctttatccacttgcttgccccagagggacaggttttggtgtagccttagtgtgacaaatacatataattgcattttttgtgtgtaagtttatcccacttattagcatttataattcagttttctaagtgaattgagcctttaatactaaactcttgagactgtgtaagacacactgaacagtatgagtcagagagtgaggcagccagtctggaaagttcaagtctgaactgagattctgcttcaccctctaactggtttacaggaatgacctggattttattgcagccagtcaacccttgagcttctcaaatgttaaaatattatttatgaactagagttgtatcccattttctgtgttttaaactattcaaatactcttgtttttctagtctttaaggaaaagtcattgcatttccaaaattattttcttactcttgatatttctgttattttttaaagttcccagatctaacatttttactgttgttacttctttctttttacaggtttatcaacttatgaggaaatgctgggaattccaaccatccaatcggacaagctttcagaaccttattgaaggatttgaagcacttttaaaataagaagcatgaataacatttaaattccacagattatcaagtccttctcctgcaacaaatgcccaagtcattttttaaaaatttctaatgaaagaagtttgtgttctgtccaaaaagtcactgaactcatacttcagtacatatacatgtataaggcacactgtagtgcttaatatgtgtaaggacttcctctttaaatttggtaccagtaacttagtgacacataatgacaaccaaaatatttgaaagcacttaagcactcctccttgtggaaagaatataccaccatttcatctggctagttcaccatcacaactgcattaccaaaaggggatttttgaaaacgaggagttgaccaaaataatatctgaagatgattgcttttccctgctgccagctgatctgaaatgttttgctggcacattaatcatagataaagaaagattgatggacttagccctcaaatttcagtatctatacagtactagaccatgcattcttaaaatattagataccaggtagtatatattgtttctgtacaaaaatgactgtattctctcaccagtaggacttaaactttgtttctccagtggcttagctcctgttcctttgggtgatcactagcacccatttttgagaaagctggttctacatggggggatagctgtggaatagataatttgctgcatgttaattctcaagaactaagcctgtgccagtgctttcctaagcagtatacctttaatcagaactcattcccagaacctggatgctattacacatgcttttaagaaacgtcaatgtatatccttttataactctaccactttggggcaagctattccagcactggttttgaatgctgtatgcaaccagtctgaataccacatacgctgcactgttcttagagggtttccatacttaccaccgatctacaagggttgatccctgtttttaccatcaatcatcaccctgtggtgcaacacttgaaagacccggctagaggcactatggacttcaggatccactagacagttttcagtttgcttggaggtagctgggtaatcaaaaatgtttagtcattgattcaatgtgaacgattacggtctttatgaccaagagtctgaaaatctttttgttatgctgtttagtattcgtttgatattgttacttttcacctgttgagcccaaattcaggattggttcagtggcagcaatgaagttgccatttaaatttgttcatagcctacatcaccaaggtctctgtgtcaaacctgtggccactctatatgcactttgtttactctttatacaaataaatatactaaagactttacatgcatatgccttttaatattaagatttcattttcaaagcatttcaaacaatttgcttacatagaaaaataacagtatagttttggggggaggaaggggtgggttacggtccttactactaacaaacaaacaaacaccacttgatttgcacttcttcactgttgtgcccagtgattgataacggggcacaggccagtatggatggcatgtccactgtgctgtagtccagacacctttgtttgtttgttttagttccttcaacctcttcctgctttgactgactgactttttgcagctctgttgcaaaattcaccatctttcctttcttctgtttgtttgtttgtttgtactatagtggaggtgtgactaagcattgaagaggctgaatgcaacaggaaaatgggaaagagaagtgcagggcctgaaaaacccattagtcatctgctatatcactgaatgatgcctaattcttatcagttacttataggtagtatacttagaaattaccttaaactttctagctgtcagtcattttccaacagaagctagtatatgcaataaattagaccaagtgaaattctttacaaagcatacaacatatgtaccaattctagacttcataattaaaacaggatatccacatcatagttaaaaataacaagtccccaaagtgacgagatatttaatgatctgatttcaaaaagccccggattgagatcccaaattccctatcaattaattacagtcttataacataaacaaacttagaaatttctagatggcaaaaggtttctcatgcatttaataccaaggtcttcaagaaatggtgatgtcaaaagtcatcatagtccataaagataaaacttctttcacaagtaaattgggttaaataactgatttttcaccctaacacactatcaaaaagagtgagagagaaagcagagagtgaggtatagcttattagctcaaaatggttataaatactgtgactccttaagactccatcagaaagtgcagtattgactgctttactatactatattgtggaaataatagggcatttagtgatcaaaataggccccattctagtcattagatcattactagtctacgctatgaaatgagcacagaaacccatgttcctttccacttacaagtctgtctaaaggctaaaggtctgtctttaggtgaattgaaaggaatagttgctattagaattagtgctattagatcagggatcagcaaactatatataaatggccagatacttgaaattttaggccatatggtctttgtaggccatacagtctctgttgaagctaatcagttctgcccttgtagcgtaagagtgccacagacaacacgtaaatgaatgagcatggcaacgtcccaataaaagtttatttatggacactgaaatctgaatttcatataaatttcatgtcataagttttcttttttcctccaaccatttaaaaatgtaaacattagtcttagcttgcaggcagcacaaaagcgggtggtagaccaaatgtggacccagggtgtagtttgccaaacccttttattagatcaccaaagttacttttcttaaaataccttctatttttcacagaaggtataaatggtaaacaacatcttaaagcatcggtagtagtggataccttggatatcactgtcactctcttaccgggtttaattttgcatggctggtgtgggcgtaattgagtgtgcatgtagagcatctttataatattaccatcagcacatttggtacttgcacccttgtagttctaggaaaagtcctaaaaatctataaatgcaattacttctagggaaagtaaattgaaatgcacattggcttataagaaactcattcttctaaggctcaggaaacaacactgtttcccatttattgcttcaaacttcttttatatatggtgtcagaattattcccagtcctaaatcaaggaatattggaacattgttagtttctccaatggattgtaagttagcacactgattaagatgcatctgactctagtggaaaatgtcctcaattgatgtctcttcttattgctattttttatttggcatttctgcctgctgcacaacacagttccttctgggaaactataaacccgtatttaaaggatatggctagtttgaatgaagttaaggcagcgatgaacagcagagatactgcagagaaccttagggggttattaggagagagcttaactcagtatactcgcttcttttttaagtaagtttccatgtaatatgctcctgtgccctgagaatgctggtcaacacattccactgaaccaccttctggggcagagatgagatatgatgagcctcgcttttc

SEQ ID NO: 13039 - DNA, 1676 bp, Homo sapiens
tgtcagccggggtcgatgtgggaaaccatgatgaggacttagacctggataccccccctcagactgctgccctactaagtcacaagttccaccactaccggtcacaccaccctacacttcatcatagccaccacttacaggcggccgtcacggtacacactgtcgatgcagaatgctaacaatctcctcacctccacgccaagatgagatctgggagctacagaatgttctggaaagaaaaagaaccggcttaaaacccacagcaagagacctcccttgtgtttgtgctttgtgcagagttgtttgagtcatttcctgcctgtcgacatggttaaaaacgagagaaacaacaacacagtcacatttgtgaagatgtgaggctggttctgaaatggaggggaaataagcctgatgaacagacctgccataacactaatggaaggtaacagaaggcgaacctccaaacacagagacggaacctgcaagtgaagctgagccagaggaatgttccaaagagccagaagcattcagctctccttaactggaagagagaaaaatctgctcacccagagactggaatgtggcacatgcagatacaaatgtgtgcattgaagatttcgctttgtttcttagcggtacctggataccacagttgctgtatggaactcatgttatgctctaaacgatgcatctcagaatttctaagtaaaggattatttttctactatttattgaactttcaaacattctcaaactttggggaaaaggaaaggaaacacaggagaagttttcagcagttgccccgagctgttttgtgtgtaatgaagtggttctttgattaaggagctctatttcttatttaactgatatcccactgccccactccacaaaataggaaaatgaagaaatctttctctctgacttgtttacatcatttcacggaaacacatctttgtttgtaatgcagtattctttctctgtgtttgacagagatggggaggggcagaggaatttaagaggttttaaaagaaatgttatgtttcttatgacttgtttccactcctcgtacaatgctattcttaggtttctacgaaacctaatgttagaaccgcatcctttcagctaagggagggttggatttattttccttgttttagagactacaaatttttaaatatcccattttgactgagaatattgacatataagggaagaagttttctaaattgtgaaagtctggttcttaattaaagaattttttttttaatatcacggttaaaagctgctgccagttagccaagacattatccaccaaattgctttgtgatttatacagggattaatcaaatctggctactataacatggggcattgtaactttaaagtagtgttttaattacagtgatgtattttagactcacattttgtgattcaaatatgttataaaggcattcttgcaccatggtaaagaatgtgtgtggtaaatctccgtttatatgtagttggaaaaaattcactgaataatgttttaatgatagggtattatgatacaatgtaaaaaacaattggttcttcagcagtacagaaagtaaactatatatgtgctatcaggaaaccccttcatactgtgtataaaattgcaatctagtgaaataaaccgtatgcaatggaccatt

SEQ ID NO: 13040 - DNA, 1044 bp, Homo sapiens
aacttctgctgttggaaaacaaagccttttgacagacagatatgtaaacaataacaataaaatgtgatgagtgcctccgtggaaatacgcaaagggacaatgggagcataatgaaaaggagcatgtaattgacctgaggaagctgtaaaagttttacagaaagtaggaaggaaggaccaggtgcagcagcttacgcctgtaatcacagctctttgggagaccgagatgggaggatcatttgagctcaggagttcgagaccagcccacactgagaccctgtctctttaagaaagaaaagacagagggagggatattctaaaccaaaggaacttgtgtgcaaaagcacaatggcaagacagaacacagcataattaggtgacaggaagaagtttaggaaagctagtgtataggctgcaaacaaaattgtatgtataagtatctgtgatctaatcctcagaaggacaggtaagatctggacacaggaagcactccatgctgcaggtacactatgaccaaagacatggatgtgcaaaagcagaagcatgtatatgaaacagctggagctgctagtttagctagagcaagggtatacagtgggaaacagacagcaaccagactacatgtacaccaaaataatttaccctgaatcctcagaaggcaagtgtgacagttaattttatgtgtcaacttggctagactttggtgtccagttgtttgatcaaacaccaatctagatatgtctgtgaaggtatattttagatgtgattaacacttaaatcaacagatttctagtaaagtggattaccctccataatacaggaaggcctcatctaacaggtaaaggctttaagagcaaagactgaggtttcctggaaaagaactacaacatagaaaccctgcctgtgtgtccagcctgctaccgagcagaatctggagttaagactgtggcaggccaggtctcactaacgcaggcctccataacaactgtttcagtactgactgagtggttaagttaaatattaaaagctaaaaaaaaaaaaaaaa

SEQ ID NO: 13041 - DNA, 108 bp, Homo sapiens
ctcacacctgtaatcccagcactttgggaggccgaggcgggcggatcacgaggtcaggagatggagaccatcccggccaacacggtgaaaccccatctctactaaaaa

SEQ ID NO: 13042 - DNA, 1993 bp, Homo sapiens
agacacctgctggctccctggacactctctgctctgcccctggcagcactgtcaccacccagctgggaccttatgccttcaagatcccactgtccatccgccagaagatatgcaacagcctagatgcccccaactcacggggcaatgactggcggatgttagcacagaagctctctatggaccggtgagtatcccaaaccacagcccatccccatctgccttcgtcctcaaggtctcacaggggcaggcagggcaggcagcctgacagccacgaccatctcccagaccagctgcccttttgccaccatttgtggcaaatcagcaactcaggattggatatgcaaagttcaagaatactgctcccttgaggagcatcatgctcagagcactggtccttgagccaggcagactctcagaccctgctcttttcccattgtgtggggataatgctccacctgcccatctcaccgaacagcaggagactcaaagccagggcatcagcttggtgccatcattgtcagcacctggtatctaggacagagaatgtgctgcgagatgcttgctgactgaccaagatacactttggtgtcaaaactcctttggagaacctcaaatgctggataagtgctggataaatataaggccaatgataataaatattatacttattgaaagatgtgtaataaacctgcattgagtctcaaaaaataaataaataaaatatgctttagataagacattttactagaaatgaataggacttacaaagatggctaaggctttattcctcctatcaggggagttcatgggagcaggagggaacacgggtgggaggaatgaccacatgctagacgtggtcattctctcttggggccagtgtctttcaatgataataatgatgatgatgaacaagatggttacatgctagagacaacgctagacccttactttatatgatcttggatcttgctgagcggtaactggcattgttcccattttagagacaaggagactgagattctgagccataggttctgaattgccgagagccacacagactgcagcacagtagctgcaattcagacccaggacagtgggacaccaaagctcacagccttcccacttccccttgtgccccttcacctccaggctccggggaggggctaagtgcttgggaacctcagtgccctccttccctctgccaggtacctgaattactttgccaccaaagcgagccccacgggtgtgatcctggacctctgggaagctctgcagcaggacgatggggacctcaacagcctggcgagtgccttggaggagatgggcaagagtgagatgctggtggctgtggccaccgacggggactgctgagcctcctgggacagcgggctggcagggactggcaggaggcaggtgcagggaggcctggggcagcctcctgatggggatgtttggcctctgcttcctcccagttcacagccagagttgcctctcctcctcctcttccccaacccccagaccatgaccagccttagaaaatccatgtactctgttgttagagggcccagagttccttctccacccccgctctctctctcttggcctgagatctctgtgcaggaaccaagatggggctgaagcctctggaggcagttggttgggggcgggcaggcaggaggccctcccttcacccccccaccctcagcccggcaacttctgggttccatgggttttagttccgttctcgttttcttcctccgttattgatttctcctttctccctaagcccccttctgcttccacgcccttttcctctttgaagagtcaagtacaattcagacaaactgctttctcctgtcccaaagcaaaaaggcaaaggaaagaaagaaagcttcagaccgctagtaaggctcaaagaagaagaaaaacaccaaaaccacaagggaaaagaaaaacccagtttcttaggaaacgcaaacgatttattatccag

SEQ ID NO: 13043 - DNA, 3707 bp, Homo sapiens
gtacccacaattttcaggtgggtgtgtaagagctaatggggccacagatgctatgcataccactgcctagttgttgctagagagccttttcaacctcagagaacatagcattccatgctaaccatcatttaaaattcctgcaataaatgaaaaaaataaacacagagctgagagtataattcaactagcctcgctcccaaatgaagctgattccagatagaaagcagattttcatatttactgtatgtgacagctgcaggaattaaatgaatcatctgtctatctctattgccttgttcctcctgtgctgtgtgcatctatccctggggttgtctgtcttcccattccaggaagacagatcagtgtagtttcaattattaattccatgtttggatcacagtaacaccagttccagttcagtgacctgcagttcctattgatttaagtgatgaattatctacactgcaatgtattattaactttattttgtctcttattccttctgcattcatgcatcaaaataataaagcaccattcacaggctaaaaggacccgtttcccttctcacatttcccataagggcgaagccaacacacaccagggaggtaattacacagagctggggtgggggctggacatttattttacctctgaattatttatctcagctgtgaatttgggggaggggttgggggaggtcctcagtggggaacaaaggggcccaggagggaagttaatgaagacaagtgacgattagaacctgggagattcataagaaatgaaataacctcaacccaaaagtttaacttctgggagtcaatctgcccattctgataatgatggggggatgggtgtaggagtggtaacgacagtggcacagtgtgaagggaaggaggcaagagaagagagcaccatcagtttctcctgccatctcttttggattgctctgcctgccccatcgcaagacctactcagcaaggtcagactccagtgagacatggatttgtggatgtttggcagaaatgtgctggccttatggctaacctaccattgtcttcatcttctttgggtaaaagcacatcctcctattaccttttgaggaacttcctttccctgggtacaatctggtaggactatcaatccagatgccctaccttgctctgaccaaatgcatgacccaagctgggtcagtgaggttctccctccatgacatttgaattacagacaaagggcacaaaagaccgagggtaagtggcatctgttcactagcgctgatgcctgggtctgactgttgagcaattgctgctctcaataccttctgaagatgatctgcaagccttgtttttcaaccttccctttgattctagatgccccaccccatagtctttcaataaatgcttttttttttaagttaactaaatttgagtgtgttttgttgctttcaacttagagaactctggctaagcagccaaaagacatggctgtatctaaagtgtccctgagccctcagagatggaaaaggtgaagagggaggggctacagatcttgtctacacctcttctgccaatcaagcaacaattacatcaatagggagatgggcaggaggtgaagtgaaggcattcctctgtcctctcgctcccatttctagttagaactgaatccaacctcccagcctgcaggactcctgttggggcaactcccaaagtcaaggagtctgaagagacacctcatctgacaatcccacacagagggaagacttctggaggggttgcctagggtcaggcaccccaggcatcccgcctatgagccaaacccaagaggaaggaaagacacccaggacctcccagtttgaaagtgaagataaagctgctaagtgcgtagaagtttccatgtgcagacaattggaggattacctaaggtctcatttctagtgctattacactcagaaattgcctcacctatgactgctcccattttgtgactcacagctctctacgctgcactggtatgaaacagatgttgtgaatgttttattgtagtttccaattgccacccttcattcatctgattcagacctaagagccttgggctttcctttcttttctttctcctcctccaccctttgattttaagggcctagaggtgaacatctaacaggcagaacctgattctacctgtcaactcagccccttatagcaatggagaatagcccagcaatgcctgagaaatgagttctttttctttccagaacttcaccacataaggagagaaggatcagaaaaccatgtgattagattatatggaagaaggtcaaagattaaaaatccactgcctctcattattagaggagggatgacagattcagaccagagcacaaaagaaaatacattatttcaaaacaggatatgaaacccagtcccaggtgattagtctctgttaagtaaatttactatctaatcttttaactgtcttccgaaattgctggtccaacattctctccctcctccattggaagcttaaccctgggagggtgctgtcatccaccttaatggaatggggagctcatttcaggggggtgtaggtgggggtggggtggctggggtggaagggtctgtaagtgaaatgcaccctgtaataaaagcaggatgtgtgcactgcagaccagcctgactggaggtaggatggggatggaggttggggcaattgtccttcctttggtttcagagctaggcccataaatgaggagactatccttcaacctcactccaggctcatcctgggaaaactggactctcctctttccgcacagccccaaggggcccacatgtcaaagaatctcatgcttcggggttgctctcaaaccagatcaaccttcaaagctttgattttaaacgaatgctgctctgcaggctaaatatcacaggcctgtgttggggcccgaagaggacaagatgtgcacttggaggccagacaggcttgcaacaccatccaagcaatgagaaaacaagacatagtggaaaagaggatctgtttctcagtatctgtcttggctggggtaccactgtgaacatggcatgcaacaatcagagaggcagaggataccaaacccaaaggaactcttcccctgtttaccaggaggaactcctttttttctgtacttcactattttctcgtctgtttagtctaaaaggctgaactattacacaaagaaagttctctccaagaatgagttttccagagaaagctcttcagacaagggcagtgtttgaaccactctccacagcctggagaatggggtgtgtgtttaacagaagggggctggggccaaacaggactccctgaaggattcccaaggtgctctgtttgtgtgatttatcccttctggaaaatccaaacatacaaatgtgcctgctgcaaaagtcagggcagtctccaggactcaggttcccacacaaagctaaccacatatagcttgcctgccctgaaggttttctctattttaaccttcgtaggttttcaaccaaaacagatgaaagggaggtgcatgtagttttgctggggatcagcagacctcatttctctctctcttcttagctcctaggctcacttcacaaaaaaccctcggagaacaggaactgggcaaaaaggggcttccctcagctcctgggatttcagaaccagacattgtcatcctgttcaccaagcag

SEQ ID NO: 13044 - DNA, 3981 bp, Homo sapiens
gtaggttaaaattacttttatttgcagtaattcagtcaattctaccctaaagatgtgttttattataaataatattcaattatgaaacaaaaaaattatgatgtttttcaaaatgcaagtgaggtttgattttttactgaatcaaatgcaaatgttacctgttaaagatattacagagaaattttattgattacaaaatatgtaagaaaattatcagctacagttttaaagtttaaaatgctctgattgtttctcagaaaaggttacctttgtattaattgttgtatgacatttagtaatgtcctaaaagtcttttgtgagaggtatttaaagtgctttgagacctgattcatgccccccaaagggtggtattaaaagaggaaaaaggacatagtagtggtagtaaagaaaaaaaggagatctaacaaaaacacttgaatattttttattttcaaaactaaacacataaaatgcttttattttgccatatcctacaggaaggaagacatgcttttgccctttcttctgctttgtatatgaccttgatcttttaccttttgttctgttcttctgtgtgcattttatggaaagaaagttgggtctgagattatattgtaattttatactttctatagacagaaaggttttcagagaaaaagaaatggttaaatatcttccagatgttgctgccttatcgaaatgcttctagaactgtctgtataagtcgtatttcagacagtactaaatacttatattttatttttgaggcatgtaattttaaaactgcagtaggttaaaattctattaaacaaatatagaaaatattttgtttataattggcctggtgtggtggcccacgcctgtaatcccagcactttgggaggccgaggtaggtggatcgcctgaggtcagaagttcaagaccagcctggccaacatggtgaatccccgtctctattaaaaatacaaaaattagctgggtgtggtggcgtgtgcctgtaatcccagctacttgggaggctgaggcaggagaaccgcttaaacctgggaggtggaggttgcagtgacccgagatcgagatcacaccactgcactcagcctgggtgacagagcaagactccgtctccaaaaaaaaaaaagaaaaaaaagagaaaatattttggttataatcataagaagaatccttacaatttaaaatatttcacttttattttgaaaaagagccaactttctcaaaggaagctgtcattaacttctgttgtttggttagctaataaattctgttagtatgcaagttaaacctgtgtaaaggaggttataatgtggtaaggtataattttccaatatgagacaatggcttaaatttgcctttggagatggagaatattttcaacatacataattttaacaaatagttttgttgctttttgttaagcttaaaaaaaaatttggatcagaaattataggattgagctggtaccaaaagaatcctaaagtacagaatggttttccaaaagagcagacatttcaatgaaaataaaaccccaaaacattttttttatatatcatgattgcatgcttttaaaataaggaggcttatcattgaattttagttccataaaaatgaaaatacatgtttattatttagaaatggttagtgactggtattgaagtattattcacacttatgtttgtaataatttatttaaagaatgccaacagtttagcacacttttgtaatctctagaacagttctatacattaaaaataaacattaaaaataaagcagttcctttaaacaacttactatgaaactataattgttaatgaaataagatattcctatgtatacattagtatgatttaagggtatgaaaaacagtgctaaaatgtggagttaattggaatgtgtgcagctgcatactcactttctgtgtttttatatttccttacctagttttaaaaatcatcacttttcggcacttcagctagacttatttcaatattataattatgattaatgaaggagcagtcagaagtagaggtgtggtattccgtgggcagaagtcaaatgaaaaaagctatattgtttacttgtttactatatcaatgttaatattatgccttattttgataaatcaaatagtatatcttaatcattgttgataaatatacaggcaaagtttgagcatcatatgtatttttatgaagctgcttaattccaaattgcctcccaccccactatctagcatagtttaagcaacacataattttgaaagaaaagtttgtaatccctcctttcttttttttgcccatttctaaatcctgtatgcccgcagtaaagatagtttggggattttaaaagttttctctattacccatttctaaatcctgtatgtcaaagatagtttggagattataaaaattttcatgtattggtgtaggttgagtatccctaatgagaaaattcaaaatctgaaatgcttcaaaatctgaaatttttcgagcacagacatgatgctcaaaggaaatactcacagagcattttacatttgtaggttagcgatactcaacaagtaaatataatgcacatgttctaaaatatccccccaaaccccagcaatccaaaacacttctggtcctaagcattttgagtaggggatactcactcaacctgtatatttgtgctaatacatgactcattagaatgattctttgtaaacttaatattttaaaagtacagcacttctgtagtatggaaggtttcagtaataattatattcattcagtagtctcttaccattatctcccagatggaaaaagaggactaatgtggaaaccccagagggtgtccagttggaccagggagatattagacacttaacagtattttcagtctgtccatctctttattccaatgtgagaaatggaagtgtttttttttttacgtttattggctcttcatatttctctacattatttttaatgtgcagtttcttcaattggttagtatttccatactatttgcaactttatggcctttaaatataggacatattatatagcagaaattttgactttaaatcctcttgagtagtatattttgagaagaaaagctatactgctcttctggatggtttccatcctttatttaggtcttttctttttgaattcaagtgttttgtatgcttagaaagtagacatgtataatattgagatcggttatttctgagctggaaattggaaactttggaaactcaggaaattgctctgacaatgttttaactgctctcaatttaagaaaatgacgaaatgtataaaaaagacaaaaataacgtgtgctgttttttccaagtgctttttctaagtgcttttccattgtgcaatgaggtgaagtttggtaatttttcggtgtagtagttaaatattgctcaatttttatttacatgtaaagaaaacagatttaaatgtttatgtggccaaaaggtgtcatttaaaaggtaaaataagtttatgtagaatgtatgttcatggtgcttatttttaaaatgtaattcaagtttacagtattacttaatgcttctttacagaatttaatagagaaacaaggctagaacacatctacatcctgaagagccgtttataacttcatattatatgatgacaaagttcattattttccttaaagttgagcaattgacttttatggtccaatgatgaacttattattaataaatgattgagttaactgtgaggcttctcattaaaatacaatattgcagctatcagttggagaatatattataaaattttcagacagtatatcagaaaaatgtttttatttgtactgtatagaaaatgtaattttgctgttaactctgtactttttaaattgaaaatgttttataaatttgcttttaaattttcttatgaagccatttgcaaattacatacttaatttaataaaatactttagccacag

SEQ ID NO: 13045 - DNA, 3982 bp, Homo sapiens
gtaggttaaaattacttttatttgcagtaattcagtcaattctaccctaaagatgtgttttattataaataatattcaattatgaaacaaaaaaattatgatgtttttcaaaatgcaagtgaggtttgattttttactgaatcaaatgcaaatgttacctgttaaagatattacagagaaattttattgattacaaaatatgtaagaaaattatcagctacagttttaaagtttaaaatgctctgattgtttctcagaaaaggttacctttgtattaattgttgtatgacatttagtaatgtcctaaaagtcttttgtgagaggtatttaaagtgctttgagacctgattcatgccccccaaagggtggtattaaaagaggaaaaaggacatagtagtggtagtaaagaaaaaaaggagatctaacaaaaacacttgaatattttttattttcaaaactaaacacataaaatgcttttattttgccatatcctacaggaaggaagacatgcttttgccctttcttctgctttgtatatgaccttgatcttttaccttttgttctgttcttctgtgtgcattttatggaaagaaagttgggtctgagattatattgtaattttatactttctatagacagaaaggttttcagagaaaaagaaatggttaaatatcttccagatgttgctgccttatcgaaatgcttctagaactgtctgtataagtcgtatttcagacagtactaaatacttatattttatttttgaggcatgtaattttaaaactgcagtaggttaaaattctattaaacaaatatagaaaatattttgtttataattggcctggtgtggtggcccacgcctgtaatcccagcactttttggagccgaggtaggtggatcgcctgaggtcagaagttcaagaccagcctggccaacatggtgaatccctgtctctattaaaaatacaaaaattagctgggtgtggtggcgtgtgcctgtaatcccagctacttgggaggctgaggcaggagaaccgcttaaacctgggaggtggaggttgcagtgacccgagatcgagatcacaccactgcactcagcctgggtgacagagcaagactccgtctccaaaaaaaaaaaagaaaaaaaagagaaaatattttggttataatcataagaagaatccttacaatttaaaatattttcacttttattttgaaaaagagccaactttctcaaaggaagctgtcattaacttctgttgtttggttagctaataaattctgttagtatgcaagttaaacctgtgtaaaggaggttataatgtggtaaggtataattttccaatatgagacaatggcttaaatttgcctttggagatggagaatattttcaacatacataattttaacaaatagttttgttgctttttgttaagcttaaaaaaaaatttggatcagaaattataggattgagctggtaccaaaagaatcctaaagtacagaatggttttccaaaagagcagacatttcaatgaaaataaaaccccaaaacattttttttatatatcatgattgcatgcttttaaaataaggaggcttatcattgaattttagttccataaaaatgaaaatacatgtttattatttagaaatggttagtgactggtattgaagtattattcacacttatgtttgtaataatttatttaaagaatgccaacagtttagcacacttttgtaatctctagaacagttctatacattaaaaataaacattaaaaataaagcagttcctttaaacaacttactatgaaactataattgttaatgaaataagatattcctatgtatacattagtatgatttaagggtatgaaaaacagtgctaaaatgtggagttaattggaatgtgtgcagctgcatactcactttctgtgtttttatatttccttacctagttttaaaaatcatcacttttcggcacttcagctagacttatttcaatattataattatgattaatgaaggagcagtcagaagtagaggtgtggtattccgtgggcagaagtcaaatgaaaaaagctatattgtttacttgtttactatatcaatgttaatattatgccttattttgataaatcaaatagtatatcttaatcattgttgataaatatacaggcaaagtttgagcatcatatgtatttttatgaagctgcttaattccaaattgcctcccaccccactatctagcatagtttaagcaacacataattttgaaagaaaagtttgtaatccctcctttcttttttttgcccatttctaaatcctgtatgcccgcagtaaagatagtttggggattttaaaagttttctctattacccatttctaaatcctgtatgtcaaagatagtttggagattataaaaattttcatgtattggtgtaggttgagtatccctaatgagaaaattcaaaatctgaaatgcttcaaaatctgaaatttttcgagcacagacatgatgctcaaaggaaatactcacagagcattttacatttgtaggttagcgatactcaacaagtaaatataatgcacatgttctaaaatatccccccaaaccccagcaatccaaaacacttctggtcctaagcattttgagtaggggatactcactcaacctgtatatttgtgctaatacatgactcattagaatgattctttgtaaacttaatattttaaaagtacagcacttctgtagtatggaaggtttcagtaataattatattcattcagtagtctcttaccattatctcccagatggaaaaagaggactaatgtggaaaccccagagggtgtccagttggaccagggagatattagacacttaacagtattttcagtctgtccatctctttattccaatgtgagaaatggaagtgtttttttttttacgtttattggctcttcatatttctctacattatttttaatgtgcagtttcttcaattggttagtatttccatactatttgcaactttatggcctttaaatataggacatattatatagcagaaattttgactttaaatcctcttgagtagtatattttgagaagaaaagctatactgctcttctggatggtttccatcctttatttaggtcttttctttttgaattcaagtgttttgtatgcttagaaagtagacatgtataatattgagatcggttatttctgagctggaaattggaaactttggaaactcaggaaattgctctgacaatgttttaactgctctcaatttaagaaaatgacgaaatgtataaaaaagacaaaaataacgtgtgctgttttttccaagtgctttttctaagtgcttttccattgtgcaatgaggtgaagtttggtaatttttcggtgtagtagttaaatattgctcaatttttatttacatgtaaagaaaacagatttaaatgtttatgtggccaaaaggtgtcatttaaaaggtaaaataagtttatgtagaatgtatgttcatggtgcttatttttaaaatgtaattcaagtttacagtattacttaatgcttctttacagaatttaatagagaaacaaggctagaacacatctacatcctgaagagccgtttataacttcatattatatgatgacaaagttcattattttccttaaagttgagcaattgacttttatggtccaatgatgaacttattattaataaatgattgagttaactgtgaggcttctcattaaaatacaatattgcagctatcagttggagaatatattataaaattttcagacagtatatcagaaaaatgtttttatttgtactgtatagaaaatgtaattttgctgttaactctgtactttttaaattgaaaatgttttataaatttgcttttaaattttcttatgaagccatttgcaaattacatacttaatttaataaaatactttagccacag

SEQ ID NO: 13046 - DNA, 458 bp, Homo sapiens
tgctttacttgacgcttttgggaatctaggaaagttcatcattctgccatacccaagataatggccctcattttcctaggccagggtgggtggctacatctctaactgtcacatctgtattctgctggaggaaagacaaagaaaaagggagcaaaaggcaagtgccaagtggtcttaaagatggtttttggaacctgccgtaggacacttctacttacgtcctattgaccagaacctagtcatgtcatatctagctgcgagggaggctgggaaattttctatttcagactgccatgttctgctgaaatttggtattctcttggaggaaagagaatggatattaggagaatgaatagcagtctctgccacatcattttttatcattatatgcaaataatgtgaaaattagttctcgatgcattgatgacttctgagtgttaggaatcaaaaaaaggaaa

SEQ ID NO: 13047 - DNA, 6367 bp, Homo sapiens
gtaagtttgtgaattgctgattgcaacttaattcagggaccagtcttcaatctatatttcattagaatgattgttcctggaatgatcatacatggactgtcttaagctagcaaaatgttcatactttacactgactaaatgggtcctaaatgatgacattggtctttagacattaacatgtgtatatttttatattagctcaagctaaggttcagaattgaagcttgatattgactagaatagctaaaagtcaaaatgaggtgaggacactggtcttggaaggtagagaaaaataaatgtcttaccaggtgttaatggtatccccagttcttagacttttgtcttctcaggcaattttcatctcaagatctgatgagaagggcatattacattggtatgcaggatgattattgcatattttgtgggacctctaatttccctggtcatctttcagaatattctgttctgccacccccagagagtaaacacttgagccgatttcttcttccccagctattctttcctgggggtaattatgctttgtctttagattagagaagcatcaagcaatagcaatggtgctgtgtccttcggcctaaattcaatagatctcatctcctagggcttccttttcacttggctcaaaggatccattgtattttggcacaaagagcctggccagggtcatgtagccatagctcttagggatgatacctcaagaaattagctgggacccatcactctgtgaaacttcacattttaagaactgagttgagggggttgttatgcacttctgtaacttgaggctaagcaaggggttaactcttgtgagagccaatagagtgtgtctgtattcgcagtccatggctcattttctttatagtaggcatatggatcttcccctctgactttgaatatcatttggtgtggcctgtgggttattttcattctttaccaccaaataaagcggcttattagctactcagttacttgctactcaaaggttaggtcttccctgttcctgcttggcagtgttaaagcttacagggttaacttatgatgattctcctggctcattttcatcagaggcatgatgactggaaagggatcacatgggtcgttggtggtgacacctcactgtttcctaggtttggatagagagatgtatacaagacctttcctgttaaattacgtgactacagagacttgccaggacaaaattttcctaagaaatcagaaaaatgattaagtgagataagtacctgggtgacacagatattagcccgttggtaaaagacaacaaatattagcttaaaatctgcatatgtagaatcattttcattagatttagagcttgaagcaccttggctctcagctactttaaactcctccccatataaatcagggcaccaataaataagtttcagctttttaaaccctggtttgatgttaagcattataaagtacgaagtttgttaccacagtagagataatttagtagaaaaatgctttgaggcttcagtatttgtaagattttgcattagccagatgctaggttgttgaaggcatttcagtgttgataatagcctgagcagacttctttacaaatgggatctgtttctatatgtgtatatgcccacttaccattcagagagactggtctttctctttgtcttccttcacattgctgtgtcagttctacacctagtcttttcagcacttagcaaattcaaattttgatttttttgtcagcttagttcactttaaggcatattggcatggtgtgtgaaagtgatgttttgccccagtattgaggacttttagatccaaataatgactcattaaatataattatgttttaagtatactgaatttctgttagcttaaaatgttaattctcaggaatgattttctcacactttgtgttggctaataataaaagcactgttttattctcaaaactcctttttcaaaaattagggagagagcagtagtgatcatttatgtgagcccctttgaaatgatggtgtcagagtgcagagaaacaatggagttttgatgccaaaaaggtttttttgcagtaaaagtaaaaatttggaattagttggcatatagaggaacccttttgtactggaacgtatgaggctggattgtgaaaaggtaatctttcgattgctagacttggttaacttagggctgcaaatctttttcttctgtcaaggtcacttaatatggaatgtttttgtcagactgtcctttgttggaatactttagctgttcagctactttgactcctaggagagaatttagttaaggttcaaagtaattaactggctttgccagtggtgagtcccacaccattattcacttagtagtcatataaatgtttttatttaaacttctctctcttcaatgctgagaataaggctttaaattactgattcacctttaaaggaatgttgtgagaattgatgtaatttctgtttctgtttccatctaaacttctttataaaaagagggattagtttttttgttttggggtaagcacctaatttatccagtaaccaacaaccctaaccattggcatatatagtctttcactcagaaataaacaaaaactgtttggtatatctgtatcattgctaatcttgtgcactttactttttgggcagtaccatacatagtctgaggctattgacttaaaccaataactgtactttatgtaatgactcttaaatttggttacctgggttcacagcttgcttgaagagaaaggatgctagaataaagtaagcagctgaagagcgagcaaatcaagacaaaacacagtggtctcagatttttcgtagtgtgggaacagtggttttgctctataccactgaaaagcactataacataattgttgtccatgatactgaagcttttcccctcacttctaggttgtttacattcagagctctatcaataagaggaatacatattacagtgaattcgacaaccgcacaagttggcagtaggtatccccaacctaatttatcttggtaaattcaccctgtttcctagtgctgctggataaaagagtgtttactttttattgctcttagacagagtagtctagataagttttcaatttatcaacatagcctagacttctgtaagtggaatgttcattagtaactcatctttttgttgttataattggaaacagaaacgaggcttattgctattgcagaaatcccaaactggcaaaggccagtatatatggtattccataatataaccagcttttgaaatttatgtgtttggattagtgccttctggttaccagtattgactctgctagtttgcacctttccgttcttaacagaaaatttgtatttgttattcctcttaaattttgtcgtaactagtgaaggaagtaaaaaaaaaaaaaaaacatgcattacattgacatactttatgtgcagcctttatttaggttcagtgaaaccaggtagttctgtatttgtgttgtagcctaaatgttgtttcttttatatccattaaaaacttaaagttacttatgttctgtgatcttaattttgttgtgtttccattgtaggttgataggtatatcgagaacaggtacgtgacaacagtttatattccatgatagaaagctaaagtccatagaaagcacaaaatcgtgttcacacattagtgtacccacacatagaaagcacaagactaatagtattctctgtatcccacaagtgccagtcataaaggccaccaggtatttgtctcagagttgctatgagcactacagtattgataagcccaagacaatgcggtatctaaactggtcctaatggtaagggacccaaaggaataatctcaataagtttgtaccacattgatggagggagagaatataaatgtcaagaatgccaaaattatatttgggggttactagctaaaatggggtttgagggctttttactgcaacttgaaactggagaaatagggacagatgtctaggtttttggtgggtggaacaggtgacatatttctgttttaagctgtagtgtgattggggttttttgtaaaaaatcttaaatcttttaggaaatattacctcttaacagtgcccccccaaacatgcagaaagtcatactttaacagggcaaatactacttgtctttgattttttttgtgtacgtttgtatgtgagagatgaagttacctttatttttttcctatacttgactgtgcttcattttaataaaggataatttgatctgagtgttctgagcatcagactaattctgaagcatatttgctagaggagctactttgcttttcacaatggggtggagaggattctttcacttgtcccattaaccctcttctagtctagatgagatgaaatctgttaatgtgtgtgtagaagaaaacgtatgttcttctactcagcattgcccttttccacctcctcacttcacctccgagtagcttgtttatcaagaatgaatgaatgtctttgtcttaaattttgcccatgtgttaaaagatgtaattctcagaatgggagagaaatgactacctttgttcctactcttttatataattatccttttagggaaagacttggtcaactctaatatatctagaaggaagactatatctggtgtagactaatatgagatgttttagaagagttaacctgaacactttgagggagagattattcttgccagcaaaaagctagccaggaatgagcctaccacattatttgagaatatcaaacctcaggcctggggggatgaggggaagaagattaccagaagtgcaggaaagagaagtttgaggaacacccttggcttagcaacatgtgataatgcaaagctgttataacctgttaatcctacgtactatgtgttctgtacctttacatgtttttaaatttaagatagtttgtaagaactgtacaaaaaaatgcttctggagatttctttggcagaaatgcctttcatctataatttcatggagaactgctttaattagcctaggtgaaaagtagtcctagcagtgtaaatatgtataattagagttttctaatttcactgtgagatctctaacttttgagtggcaaacagatcaagtcttttgctcatagacttttctgtggggttattaaaatgcaaaagctttattttttttaataatgccatactccattagtgtcagatgatggtatggaatttgttcccttgctttcccccactgttactgcttcagtttatagattgccagcagagttcagaaatagagcagggatttacccgttctttgcttggacatcccattttcttttgtccagacccatgttggcaatcatgtatgaactgtgttatacttctcagtgctttcttttttctttttgataagatggatatcaaaaatagttgctgtgcaaaagttagtagtcttcttcaagaagaaaaccaattctttttctaataatatcctgtgaaattgcttcattcattcatttatttttaagccaaatgtcagcagagtgctgctgcttttatctagtaattttgatatgtaagtattaatgcatttttaaaagatgtctacattgaaacatgttcttcccagtgtcctgcttatgatgctttgttcagattttttgtaagagaccagttagtacactgggggtgtatattgtgtacatgtgtcattttagttaggcattgtaggccaaatgtgattataaatgaagttgatgaacattaattttgttattagtgagttttttgaattgtaaatggatttccagtttaccttctgttgtctacagcttttttaattttaaggtttgactaattgtatccatctcattgtacagtgttttagttgcaagcagaaagtagaatttggtataaagcaggttatttctatattgaaaggagtacagttgaaattgtagatttaagattgttaaaatcatgacaattctaacttgtctattctaacctattgtgtacaatctgattttttaaaattgtaaacatgtatgatcttggtttcatgtgtttttgaaagtgttattgtttaaaaaatgaaaaaagcatatctgctaaagagctgtcagttttcattactgactctgtaaaatacactgttctttgtgtactgtgtgttattttgccagctgctgcattagccttcaaaagtatttggaaacttaagatgaactacatttcttgcaaagtacattcctttctgtggtattttgtcctgtaactgaagtatagtaattattttatggaaatgttagcaattctgtaccaactttgaataaaatgaaaaatttata

SEQ ID NO: 13048 - DNA, 6367 bp, Homo sapiens; identical to SEQ ID NO: 13047

SEQ ID NO: 13049 - DNA, 6367 bp, Homo sapiens; identical to SEQ ID NO: 13047

SEQ ID NO: 13050 - DNA, 379 bp, Homo sapiens
ggccgtcggtaacagaaaactcagtgcatactttgctgttgttaggttgtcaatatagtctttctgtaggatggatagcatgtttgagaggtgccaaacaagaacttttggggttagtagtgtgtcttgtggagggtattacaggactgtgtaattataggactctaacttgacatggcttggcacccacttgcagctagtgggtacagggtacaaaagatgttagagaaaagctctacagattacgtacttctgtgtcttcgtatgctcaacactgtcctttgtcctccatgaaagatgaaggaagcaaattatgtatgtactttctttgaccttctttaatctctgatactttttagattgcatgattttactaggc

SEQ ID NO: 13051 - DNA, 526 bp, Homo sapiens
catccctaaagcctcacattaggaggcattggatgtgttgtcccattatcgatgatactaactttgatcttggttaaggtggtgtccaccaggtttctccagtgttagttactattttttccctttggtaatatgtaattagtggggggatattaaaaaccatgtaaataacctatttctcatcaaacttgaacccctagttttagcattcatttatctatgaatcttgcctgagttgttactgtaatggctattttctagcctttttttgatggggaggatactgtactcaagagcttccccttttcctgttcatttgtcagtatgaactcctggattactttgttcagtgagttattattcattactgtcattattttgcttagatgtttccagatttagctggtttcttttatcaatggtttctttgtcctttgtgacgtttccatcaattcttgagtgctttgcattttccagcacagtaagatgttctggatgcactgtgtcatttccctgcctcagtctg

SEQ ID NO: 13052 - DNA, 379 bp, Homo sapiens; identical to SEQ ID NO: 13050

SEQ ID NO: 13053 - DNA, 526 bp, Homo sapiens; identical to SEQ ID NO: 13051

SEQ ID NO: 13054 - DNA, 379 bp, Homo sapiens; identical to SEQ ID NO: 13050

SEQ ID NO: 13055 - DNA, 526 bp, Homo sapiens; identical to SEQ ID NO: 13051

SEQ ID NO: 13056 - DNA, 1076 bp, Homo sapiens
ctcaacctctcaaatacctggaatgacaggcacatgccaccactccttgtttagttttttaattttttcattttttctagcgattgggtctccctttgtcgcccaggttggtcttgagctcctgggctcaaatgatcctcttgcctctgcctcccaaagtgttaggatcacaggcatgagctactgtgcctggcctaaatcatattcatatcactaacccagtattcctggctaaactataaatatcccaggaaaagagtctttgtttgctgcaaaactgtataaagctggaatcaaatcccagccctgccccttactaggttgatctggagaagtttttaacctctctgcacttcaaggtccaccccgagtcctcatctataagatagggaggacaggttagctaaaaggaacaaatggaaatacctagtaaagtaactgataaatatgcaatgaactgtatttctggtaatacctttactgagaattagtctgcaagactgattaatatccaatgtgatggttaatgaagaatgaagcattctagcaatctgacatgggccccctgtgtaaaagggatcgcacacacagagaaaaaagaagtaatattgggagagaacagggctttgcttaaacagaacagtatgggccaccagcagcagtgagagacaggtaaggcctctgtgagccttcagtcggcagtgggtcataagaaaatagaaatagtgatcaaaccaggaagagagaatgaaacccattctcactcttttaaaagcttctgtttggagtaagcccaatggggagccatcagtgtctctgacatccatatcatcctattatacttccttagctcaaaccacactcaagaaagcacaggaaatcagaaccacagtggaagatggatgagaagctggaagaggaagtgttcagcaatggcacaccattctttgccttattctatgtccctgagcttgttcagcaacagcagcaatctttcttaaaccaaagggatccatgcttggatcttcttcacaggggacaagcctgcaagccagataccatttccctgctaacat

SEQ ID NO: 13057 - DNA, 1076 bp, Homo sapiens; identical to SEQ ID NO: 13056

SEQ ID NO: 13058 - DNA, 366 bp, Homo sapiens
ttctatttattgtaactgatttccacttccatcaaaacaacaacaaaaccaaaccaaaaaaccatgctttctccagggtcacaaatgagcctatcactaagtttaataaacacttttcaatttccatttttaaacagtactaaacacaattagctcccttgaagcatcatattttctcagctttatagtagctgtaccattcccaatttctatctgcagacagcagacttccctagctggcttaaacataaagaggattattgatagttcctcaatctcctagaagcctggagaatcaggctgggatgatcaacaagacaactgcacatagccaggagagaagtccaaccacatcacaagtctgag

SEQ ID NO: 13059 - DNA, 3008 bp, Homo sapiens
gatctggtgcctctttctcttaagtccaccaatcctactggattagggttctacccttacgacttcatttaaccttagttacttcataaaagccctttctccaaatactgtcacactgtgggttagcgtttcaacgtatgaattttgaggggacatgattcaacctgtgacagtgagcattctcagacctacctaactcctgttgtagtccttattctgagtggtcctcagttctctgagtggccctgaccaggtgtcatgcccacagtggagcagtcgcctcaatgattgctctcatgggcacataggcgagtcctctggggggcattgcaaggcctctcactgcttagttccccatgggaaagctgaccttaacactactgctttgtctacttcagctcctgccaccagaagtatactacagcaggtggggtgccaacatgatggctcaaactccgctaaattccatgaggtccccttggcctatggaaattttattatttttccccttattctcctcttctgtttttataggctcagcatagatcaacaggtccactacctatacagatatccaaatgggcaatatgatacagtgccccatttttatcatacaaaggcattgtctactctctgtgagagattattctggagtcccttgccgagccaccctttaaactttagaaaaggtacaaaataatttctgagacactcatgtagcatccctatgaggtcaattccaaagataccgatgactcccttttccctctccatgcccaagtctttaaatagatagattggtgtggatagacagattataaatgagaggtaggtggatagacagacaattgaagggtttgctcaattatacatgattcatgatagatgcataaattcatagctataggattgattgatagagggtagatgccagatggatggatgatgagatagataataaatgataatagctagctagctagataactgcatgggttttgcttcttccaattaagccccgaagaagtgagttggtgccccaatgttggtagttcttttgactgagtggtactgagcacatgttgttttgtctgtgtgctgtagagcaggggtcagtaaactatcaggccctggaataaggccaaagaatcatatataatctggggcctgtttttgtatagcctgtgagctaaacatgggttttatatttttgaaggtttgtgaaaaagcaaagtgacaatggcaatggcaaagcttagaatatttaatagtatttaatagaaaaagttgactaatccctactctgaggccagtttagaggcaatagaaaatgttcctttcaaaatcctgttacacatttccctgattttttcaggtgaggaaaagggagtctgggatggggatttagcatttcttttttggccaccacagaagattaacattaataaatatttattaagtacatgctgtaaaattagaactgcgtttagtgagaaagtggtacaaaagaatataagtcaaaagagttgaccctcaaggagctgcaaactcaggaaaactcaagtcatacatgtgaagtgtgaagcaatagtacaaaacaatctatgactaaccagctgaagaaatggaactaacagtaattgctgttggattaagatggtaacaaaatctgcacaggttgaagtcaccagggaaaaagagccatggttttgactttaaagcatgtttagagatgtgtaaattcccccaaactgggaagccaagatttaagtgcttgtaatttcctggtacttaggaataccaaatatccagtgacttattaaaataggagagtattggtctaggagtctgaactccagagccatctaaacagtggaattattcttgaagaatttttaaagagatttccagtaatattacttgaatcatgggttgctattattcatggtgtgataatctgaatgtatgtatcctttggtgatgttgcaaaagcctaatcccaagacttcagacaggattctgaggatcataaaaattcatcacagagccctcaagccttcgtataatttggagagtaattactgctttacactgattaacactggaaaatcttttaattgacataatgagaaagaaataccaatgatacaatgcatccacaagatactggggctgtacaggttctgctctaatcatatgctgaatgacgtcaggttccagatattctggacaagtaacttttcattcttcttagctggtgaccagctctatttatataaaatctctcagggttaaaaacctactattgtgcatttatctagcaaggggctgggaatgaccagcccttgtgatctgtcaatcatgagaacatgaagtttgatttttgaagtattggatgaaaaataattgtcaaatacattcttgtaatttttatcactctaattgccaacaaagtacttgggcaagacttggggaactcatcctctcactgaggttctaggatccttatttcaagcccatttcattccataactgatccagaagtcacttttatagacccttatagaatcaccctttattatattaaagcaagtgtgtgccttgtgtagtttagatatgccagtactgttgtctttggaatcaagagatgagttcaaattactagattcttgtgtagtatatctatgactatataaaaataatttcaatactactacagtagtttttagattgtaaaaaaagctgttgttgtttatagccacttgagataactgaggaacatttttttcttttggccaaatatgcatttttctgagacctctctggaggggagtggaacgttacaactagaaccaggctctgggaaatacaaccacatctgtgtttcgtaatgattttgaagctagattttagttgtagggattttttgtctattctgccaggggtattaacatactcacttcctgtaaaaagatttaaaaaaaaaaactaagaaaaaagaaaggaaa

SEQ ID NO: 13060 - DNA, 3008 bp, Homo sapiens; identical to SEQ ID NO: 13059

SEQ ID NO: 13061 - DNA, 1611 bp, Homo sapiens
gcatgcgtgtaaccccagcgatttgggtagatctgagacaggagaatcacttgaactgggaggtggagcctgcagtaagccaagatcgcaccattgcactccagcctggttaacaaaagcaaaactctgtctcaaaaaaagaaaaaaagagaaagggtggaaaagagggattccagagtgccaggcacacagattttctggaaggtttacatgaggactgctgtggtttgaatgtgttccccaaagttcatgtgttggaaactcaacccctaatgcaacagtgttgatcagtggaacctttaagaggtgattaggtcatgaaggctctgccctcatgaatggatgaaggtagggtgggttagttatcttgggagggggttcctgataaaaggatgaggttggcttcctccctttctgtctttccccttctccctctcacatgtggtcactctcttgcccttttaccttccagcataggacaacacagcgagaccttcaccagatgcaggcccctcactttcccagtgttcagaaccataaaccaagtgaacccttataaatcacccagtctgtggtattctgttatagcaacacaaacagactaagacagggacactcagtgagctcttctctctacttgatggagcactccctgcgtggtgccttgtatttgtagacatgatgctgtaaatgctctttgagtgtctcgaaggcttttatgtttgaggagtttacagagaagcccgtacagggttcaggtccattctgttgcttctttgctccttagttcctcccctaatctgatgttaaattagatcatagtgtggtccttggaccaatagtatcagtagcacctgaaaatcatgctggaaatacagattcacaggctgctccccagaatactgaagaagaaactctaggagtgagacccaacaatctgtgtttaacaagtccccaggtgagtctgatgcacaaagaaacgtgagctgctgtattagatggtgttgagttcatgccaccgaatcactgacacacacatctgctcactgcttgctcttcgcacaggcccctggatcctcctggaatccctgatccctgttgctcccttgcggagttttctagtccctcttatttgaagcatgtctttcagagcctcgcaccacccagcttgggtatctggtgaattctgtggtctgcatgtccatgtttttgacattctgggaagggtggcccaggctgtgatttgccatctactgctgcaggctatggatggtattcagaagggaggggagatgctgtgtgcgtgttctgaagggtttcccactaaatggagagactgactctctccataagtatttgatttttactttatctcctcgttgacttcacagtgtaagtgcagtttgtctctactgggtgatgcatgcagataaatgtttatgtgaacataagaagtctgcatgtgtgggtgaactctccacatcatgtcatttattgtccatcattacgtatctgtggtgtctagcacattcctctaccttattttctgtcattgtacctacttctacctgaacacgtattaaatatcttattaaaaatacacaaatatta

SEQ ID NO: 13062 - DNA, 338 bp, Homo sapiens
tctcaggccttctgggaggttccagcttttcctggatgctctctctctctggccagctcaggctggagcagtgggtgttggtgccatcctgtggctataggtgataaaccaggttgtgttttgacccctagtcttgaatcctggagttctcacatgcgtggatttaaatgctgtgtctttctaagggcagattgtgcccattttccttctctgcctctcaagggactgtttgctgtgtttattgacttaccattaaaaaaaatcatatacattgatgaattagattgtactccataaattatatatgtttgaaaaataaagaatattttttcaatttt

SEQ ID NO: 13063 - DNA, 7096 bp, Homo sapiens
gggactacatcaagcacctgcgcgacatctgcgaggtgaggcccggccggcgggcggtgactggggacccggtcgggggaggcctaaccacgtccgcccgcagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatgtgagcgcgcggcccccggcccctacctgggcgctgcgttcacagaggctgccgcgggcgccagcgcggacagcgggtggctggtcccaaaaccttccacaacgcctgggccccagctccagccctctatctgccccgctgcccgcacccttcaggacagttttaggatggtctctgcttctgtgtggcgaaaccaagtcagggaacgctcctgggagcagagggctggggcgtcccccaggaaggacttgctttgacagataggagggcagaggcctgccgagcgccgcaggggctgttcagagtgagctctggggtttctcacacagggagaatttacagcctgcttaggcggcagatgccggctggcatttaccaaggttcactgggccgctctaagtggacacctcctagcctcacctggtagagaagggccttgttttggccctcttgggcagtcgagcgagggtgagcagaggatgcctgtcccacccaaccccctaccaccgccgcttttggcattgttatcccgtccttgttatcatggatttcacccagaaggctagcgtgcagccgggacacctgctcatattctcaccattcccacccctgtgtgtgactccatgtagcttatgccccagggaaataggtacacacagcctgggtctcccctagcccccagcccagctcctgaaggaaatgtagaggctcttgcccttcccacacatgcagctggattgcctgtgggagcagcagagagctctgctaacctccagctgtgccccttagcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacaggtaggagggcactgaggcagggaggcagcccacgcctctgcatgcctccagtcagccagtttgagcattagcagtgtgctgggcactgctgcagccctggggcaacacacagaaaactagccctgtcctgatgagctccttgcaatgggggaagaggatgccaacaggatattaagctctgctctgtgcttgccatttatggagaagagaggggctgtgcatctgatagtgaggatgtggtcaaagggcacagccccagaggaaagcagctccacacgtgggggctgcaggggatcctcaccctttctctgtctccagcctgcagcagccttccatctctgttctgccccagggacttcaaggatgttgaagccgccttgcatgccatgaagaacgtggcccagctcatcaacgagcggaagcggagacttgagaacatcgacaagattgctcagtggcagagctccatagaggactgggaggtgagggcctgggggcacagaaaattccaggaggtcttggcccctcgctttaaaatcatgcttgcccctgaaaaatctagaagggagctgaagcagggagctgcgctcctgggagctagcaacagatgctcatggtgtgaaagcctgtccccagcgtgggctctggacctttgctgctgcctaccgtagcaggctttggcacctggtggcctcttttctatgtgaaactcctcccatgagcagccagccagcccaggagaagccctcaacagaggaagtgtgttcctcagctgtgttctgttcctctgccttcaggggacaggccagatccctgttttagttcacttctgggactcctaacagaaggctgcaggcccaacacagcatgaccaaaaatgcatcgccacccatcagagcctcctggttctgtttgtctgacttgcacatttccctttgcatctgccaatcttgccttagaactaatgacgatgttcctgtccccctccacccacccccacttgcatctgccaatctgccacctcctgatctgttcccgaaggctccctacccacatgggtgctgccaccaccatgcaccagctgtcagcgagagaaatggcctggaaatcaatcagtatcagccacagaacattatgaaaatacagattccagggccccaccctagacacagtgaatcagaagccctggggcggggctgaggaataggggcagtcagctgtgaggcggggctgagcaataggggcagttgtgaggcccagccctggctcagggccctccagagtcactcatcccaaacaggccaccgccaaccactcccagctggggtttgcattttcaaggtagaatgagaccagggcagggcttagtctaaaagtatgaagcccaagggtggatgatggaccttcaggtactcagtgcacttagctgggaagagggcctccttagagatctcaaaggttggcctcagaggtgaatcccagacaggcctaattcttctctagggcagcactgtccaatcaaactagtatgtgagccacatatggaatcgtatgctatgcagtagccatctttaaaaagggaaaaaaacaagtgaatttaattttaataatgtttcatttaactccaaaatagcatttcaacttgtgatcaactatcattaatgaaatattttacattatttcatatgaagtcttcaaaatcaatatgtatcttacactgacatcacatctaattaatatggattagccacacttccagtgcccaacagccaccagaggccactggtgacagggggctcctattttgcaaggacagccaactcacaggccagacgtgccacctcttcctccccctcccaccatggcctggccaggtgggcgctgcaggcaaggccagggggaggtgcgccacccacccatgatgggggcaggaagtggagcccacggttgggtatgcgaggctcatggttctccttgggatcttcccagggagaagatctcttggtcaggagctcagaactcatctactcgggggagctgactcgagttacacagcctcaagccaaaagccagcagcgaatgttctttctctttgaccaccagctcatctactgtaagaaggtaccagagctgctctgccctgctgccccaagttgagcaagtggagggaggggagctgagggctgggagcagctgcccagaagacaggtgccagccagaccatacccggggagcctggccagacccttggggctgggatggggtggctctctgcaggtgagcctggtggcccaggagcagcaggcggctttcacagtctgaccaggccgggtgctgttgagagcatgatctttcctgacctggccgctgcttgctcctcaagctacctcttctctccctgcaaacctccacatcccctctctccaaccccggagtcccctgctctagccacctcccagcttcctctacgctgccggcttctgctcctctttcaaaacatggcccagtggcctcatgtccatgaagccctccttgtccacgggtgatctttcctacgtgtggtgtgagccactgtcttagtctccccacctcaaagacagggccaaccccgggctagtcagtacctgcaaaataaaggagcaaggcctctccactcatggctcagcatgtctgtgggctgcagaaggcatgctctgccctcaggatctcactgtctgctggggaggtggaggcatcaccagcagcccctcctatggctggggagaggaggtgggagcagccaggaaatggtcaggggagcggttcagcagccagggctgaggccagcatctggcaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggttcgagaccctgctgggccttgccccgcccccagggcccacccggcgctcccgcctgcctggccgcctgccggtcaggagagcgccgctcagccctctcaggttgcagggtgtagcaaggctccaggcacctctaggtcccagtcatgagcataaggctttgccttcatcacctcaatggcagggttacctgaccgcatcccatgatacagtttcgcagagttcagccccaaggcatgggtctgctggcttttggggagttgtttcactacacgcgctcacatgtgcacacactccataggacggggtcctctgcgcagtgccctgggttgctgggacctgcgggacccctttccagccagcaaaagccctgggagagccttggagtgggctgtgggtactggcctcagaagcctcccctgccccatgcacgcagacatctccccactacaccttccctcctgtccacgggcccccacattacccgccacagtgaccaggtcggctcttggtctgggaaggagcctccactgcagtggaaaagacactagacatggagtgaaggtgagagatgggtgggcagaggaaggactcggggatcttcattttctgccaggagccccaggacaggacaccagagcatgccctctgccctggttggccaaggcaggctgactgtgcagaatgggcaacagtccccgctgtggccagtactgagtccccagtacatgatgagaccctgggcaccaggaaggtgcaggtgtgcagggaactgcacctggggccacgaagtggggcagcgccctcacctgtgccccttcctcaggcttctccatcactgaactgcagaggaagcaggccatgctgaatgccagcaagcagcaggtcacagggaagcccaaaggtaggcggacagcagccccacctcctcggctgcccggtccttaccctgctgacatcattcccttctctgaaccacaaagccaagccagctagccaccaggcctgaggggggcccactgccctttgcagctgtttgttcccaaaggttggtaataaggggccactggggaagcctgggtcagtatatggttgacattcttactctcaacaccttggctcccccagatcagggccattggtgacaatgcttgtttccccagggttccttcctgacaggcatctggggttggtgtagggatggagctgctttccccatttctacagagagccatgcccctgaaacatcacatgcctttgcacaggccacccccctcttcaggctgctgcaggaggccaggcccaggccagagaccccaggcagcctgagctcttggatgtggtcagctctccaggagcaagtcctgtgtggcaaaactgcctcctacggcggctctgaagcagagccctgggacggaccccatgctgtccccaacagctggggtggcactctgccctgggcacccatgaccctctgctgtctctccctgttcagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaa

SEQ ID NO: 13064 - DNA, 819 bp, Homo sapiens
gctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcgggtatggttccaagccccagcttctcccaagttgggcccataaaaagctacctggttctgcagagaaatccaagcccaaaacagctctggcatcctaggtgcagagcactgggtggtgggtgtcggggcgcagtgtcacagccttcctcctcctggagagccactactcctgctcccattcctcttctggtgagccctcgggggccagagaggagagcagtcgagaaatgagtgtgtgcagacactaggcacccctctgcgatacccccgcaactccaggcgctagacatttcccaagccctgaagagcactgataggggactgctcacctcacacacagccccgggagtgggaaccatgacttacacctgaagaagttgaggcacggtcaagttattagccctggagatagcagagaggggacctggattccatctaagggggtctccagtcttcaaggaaggaatccaggtgcagtctccaaaaggcctggctcagggcgtccaagctgagggccgtccggcggggaggtcccaggccctggtgttcagatgctcctcctgccccagatcccctgggaaactgtccactccgcaccctaagcctttccccaagttgcatgttagccagcgggcgcgc

SEQ ID NO: 13065 - DNA, 3616 bp, Homo sapiens
tgcaacacaagtcaatctttattgaaaactgcagtattaatacataacaattcttgttacaataaacgtgcttttgagatttttaaatctgagctcatctcatcagattgcataaaaaattaaaatagtatcaattgacacctaactgaactggctcaggatggaaattccattccttggcatggatacgtaagttcaatgcagaggtgagggatgcctttaacactggaagacaatgctgacttagcttaaaaaaagtaccgagagaacggtgtaaaaaacggtatttaaaaatcatttttaaaaaaacaaaaaggaaccgtttcttctttagttacaatccatgaggctctctagggcctctccgtgtggccagcacagcaaccctgctaggagcacaaacggctggcctgagatctggcccagctgccttgcccactggtctgcacagggactcatgggcacagcctgtggtgaggaggagacacctgtcatgccagtcctgggagcacaccacccttctgcaggcccgggggggggtccctacacagacgccgctcatcctctgtctccccttcccaagtgacttcacttcagtcctgtggaccaagataaggctatccccacaggctctctcttcttcaaataatgagtaggaaaaagagacaaactttctgaaacatgcagtttccgacccaaataggccacataccccaacttctgtgttacttggtcagttgagcccctggagccctcaggacctactgataaagcatgtcctctgcagtatactcaagagtctgctgcccttcagaaagccagagggaacactcacaaatgcagaggtactagaggggagaaatacgtgctctgccttcccccaggccaaccacactctgctttagagaccctctcagaaagcaccagagaggaggaccagacgctgccacccacctcaagccacacccctgccacctgctgctgcgcccaatggaggtcctgtcctgtccgggcaacagccaaactggcgacaatggacacatccaacagtcagctgtcggataaggtgaaggtggcccaactgctcagagtaacactgttctcaaatgtttaaaaaggacaggtgaagtctgggtctccttttttaaagcagacaccaatacttacataactagtacatgttggcctttcaccagcactcactggcactcacaggtgccttacataccttacgggggccaacactgacaggtattagtacgtcgcaagttgctgtaataatgtatttcctctcgttactgttgtgtcccccaagacacatgcaaattatttcctagacctcattcatcacagccagatgatgccaccagaaagagcaaggtactgtatgcccagctggggaagggcaagacactcactgaccaggtgcccaccccaaggctcaggaccacccccattgcctgtgaacacatttgcatagcactcaagaaggtttcccagaatagcgacaggtaggcctacaaaccacaccaagaagaacgttcttaacagatggctcacgagagacataaaaggttctggaagtgccttcaggcccattaccatgactggccctgactctggccctcacagagcggcaagttcatgggtcactggctcacactaaatgctcagccgccagcacagatccaaacaagacctccatgagcagagaaactgcagcggctgaacacactccccaagcctcaggggagaaggtgtagaacaaatattttttaaatagccatcatgatgtccatgtttacatgaactaggtcctttgcttacctgctgtctcaacttctaaaagaatagtaattcagctgaaggactcccaaattaggaatgtcaaacacacaaaaagcaaatttctcagaatgctccaccatatgcttcgggacaaattatgaagctttgtaacagaattttgacccaagttctatttcttaattgactttaattttactagaagcgaatgttgataaaattacaacctatgacagttttgtgactatttcctaagtccagattcttacctgatatctacctttcgtatctgacagctgacgtcctaaaaatttcaaagtcagaaagatttctgcacggatgtgcaatgcaaacttatttcataaagcctctcaacttcataaaagggaaaaaaggttaagttacagggaggaagaaaagtgtttatgaagctgatgtaaatggcgtgtggggggtgcagcccactctttaaaacaccatcctgtgtgtgccaagtaccaagcaagcctgaagagatgcctgtaacttctaacctcctcctgaaccccaagactccagccctcacaggagttgtacatgtatgtttccattttgttgtgtggggctttttaaaagcatacactaacattgtgagtattttatcctaatctattagcactcaattgggaaaaaagacttctctgctacttggtcagctgaacccctggaaccgttagaacctactaatcctgccaaccatccactaaacagatggaattaccaacagagacttgaagaaaggggcacaaactgtgtgcctgcggtaaatgtctgcccccacacatagacactaagatggattaagtgctcatgaagcaatttaaagtacttatcagtaaacattctatgttaatagacatcaggaataaagaatctgctgtttacaatgatccatgcaaaaatattcctaaacttcttataaaataagatgtgaaaaagaaaattataagaagtacttactataaaaaataaggttaccaaaggctcagtggtcaggtgtccccccaccaaccaactggggcagaatgctagtgggcatcctcactgggcgccagtgccctgacccagctaccagcaaatgaagaggagcagagccccctccccaccagagcccacagcactcaaaccaccactgcactgggaagaagacgcacgctcctgccctagaggccgctgaaagggacccaggccttacatcccccacccccactctgaccctcactgagaaccgacatgcactctcatggatacaggacgggcatattttgggggcggggtggagggaagccttttcatttcttatgtacaagattcagatcctaaactcaaattcctctcccacaataaaccctgccagcaaacgcactccagcactgcctggccctctctgctgtctgtgcttgctttgtgccaagtgccctcagctgcaaaagagatggcaggagaggctcgcagacaacagacactggcctccccctcgccccatctctaagcgtcccctccagccggcctcagcagacaagtcaccaccatcaggtgggtgatcccagaagcagctacaggtttctacatttccagacatatccacggccctgcctttctacaagaaattggaggaattttaaataaagttttgttcccttttaactcattcttaaatataccactttcttcataacatacagctgaaacctttgcccttctttgttggggaaaaacagcaatgcctacctgttttcagctgattcaaacatttctccaggaaaaaaaa

SEQ ID NO: 13066 - DNA, 7562 bp, Homo sapiens
aagattttaagatgtttaatactcaattttgcacttcaaaaatatattaagagctgattctgttgaaagagcgtgtgtgtgtgtgtgtgtgtgtgtgtgtgtgtgtgtgtgtgtgtgtgtgtgtgtaggggtggaaacaatgatagagattctaaataaatccaagaactgtgaagggttcagtgagaggaggacaggcaggggcatctggacatgggtgtgcatgcacagacccggctgtagccgggtggctgatcagcagcaccttgaagactttacagagtgtttctgccatctgcacccatcctggccccgcccggccctgtttcccctcttactgcagctcatcttccccgacctggtggaggggctggtgctggtgaacatcgaccccaatggcaaaggctggatagactgggctgccaccaaggtgtgtgtggtgaccgggggtggggtgggtatacctagggtggggtgaggggcggcactcacgctggcgccctgctccctgcagctctccggcctaactagcactttacccgacacggtgctctcccacctcttcagccaggtaagggggggaacttctgcagatctggggtgatctgggatttgcccctcccagctggctcggtaggaggcaggcgggtgtctttggcatctgacctggctcactccagatgctaagccatctgaaagacagacatcccctcccaaggccccacacctcctacctgcccccaccctgtctcccctgcctgctgagtggggcaagggccactctggcagtgacatctgccagccccctctaagcctgcgtccctctgtctgcccctctgcatgcctccatccatctccctgggcctaggaggagctggtgaacaacacagagttggtgcagagctaccggcagcagattgggaacgtggtgaaccaggccaacctgcagctcttctggaacatgtacaacaggtgcgggtgggatcagcagccctgggacccagcacaccccagtgggggcccttgcacactgccccctgagggaggcaggcagacaacacccttgccctggtttgtagatgggcacgatattgggcctcaaaggaggtcatttcctgcacaaggtcacaccctgtgaggggcagaggggaacagggtttcagactccgggccttgggctcttccacttttcctcctcccctgggggcttcccgcttgggaatgttgggggtgttagtgacatccctgactccagtaacccagccttgatgttgacgtctgcaaaatgaggaagaggtcggatgagcctgtggttttcaagctgtgctccttggagccccctttaggggctgccctgccctgcaggaaggtggccaggccccctcactcacgtgccctccttctcattcttctacaaatattaagcacctgctgtgtgcatggtgctaagaaaacaatagagaatagagagacccagggcctgccatcccatatggtccaggagacaggccagtagcagaaactcccacagcacaggtggcggtgcgcatggctctgagggggatagagagcaaaatttgagagcccacctggtatgtgctagggagtccaaaaagccgtgacagggagcctccagttcatttatgcagagcaggtccacgcctccctgctttaccaattggcagtgttgggcttgggatgcccctcatcctgtcctggggtgcccacctctgcctctgcccctccccctgccccacagccgcagagacctggacattaaccggcctggaacggtgcccaatgccaagacgctccggtgagtggcccctggccctctggcctgccctggcctttgcccccatgacccagccagacagcccttttcctctgtatctgcagctgccccgtgatgctggtggttggggataatgcacccgctgaggacggggtggtaagtgaggggctgtgggctcactgggggtgggaggtaggggtgaggggctcactggcccctgcccagcagggacaattcttgatccagcccaggggagcctccagggccagcagtggacggtgggcttcttgtccactttcccacagtcttgccaagcctcacatctggcatagcccccatccttctggctggggaggcctggaaatggggagagctggggccagggctgggccatcagaaggtcccctcttccctccccagcagcacagccccaacttggtccctacccacctcaggcccagggtgtacgatcttttttctaaaatgtgatcaagccattataaatcattaacgcatacagcggcacggtctcccttttcccgtcacctgcagcggttatgtttgggggccgtgtgtcacctctcctgctggaactctgggagcaggtggcctgaggctgggatgccccatcagcacagagctgctgggaagctgcagggtccagaagtgcccagagcagccccgtgcgccctgaaaataccaggctttcccatgcccactgggaggtcctggaagagcagggtggtgggctgtgccagccccctccacccagtctctctcagaccctcggcacccctcacctcactgccgagggcactggggctttcccaggccagtcccaccacggcagcccagccctcgcctgactcccactcctagcagttgtgagtgggctccaagggtcccaggcccttcagtggggctgttaaactggtctccaagaacatggggagccctgggagaagaaagcctgggaggagcagcctgtcacagctgctgggcctccctctgcctccctgcaccccctctcctccccgagcttggggcatcaaacctgccttggcaatgggggtggggaggggcaggggctgttgctgaagctggctccttgtcctcaggtggagtgcaactccaaactggacccgaccactacgaccttcctgaaggtgaggctttcttccccagccctgggccagcttccctagcatgggcccaacctcagggaggtgttttcctggggtcccagccagggtgggagcttgtcctggagtgagggccctgctcaggtcaccccactctctcccttgcagatggcagactctggagggctgccccaggtcacacaggtgagacttttggccctcctgcccttacatctatggggagggggaagcctctaccctacctgctaatcctaggcagccaatgaaagcatgtgcttgtcctgccctccgcagccagggaagctgactgaagccttcaaatacttcctgcaaggcatgggctacagtgagtacatttccaccccaccccacaccacctagagaccggtgggcaggcagtgctggggttggggctcctgtgtgcagggctggcacgtggtgtcaggtggtagtagggagcccataagcataggagttttgtgtgacctgggccccggatgctgggccccacagatgccacctgagttgcaagttggccatcccaggctgtgcccaactcccctttgcccttagggaggacttggcgcactgttctgatggcagtgctgggcctactgggggaagggactcttccttccgtgctgggggtccagggccaggggccgtgtcctgccagggaagcctgtctgggggtgaggcacactcccctcacccgccccagggcttggggtcagagctgggtctatggcacctgagaaggccttttgaaacaactcatggctgcacccaggggcatcataggagtgggcttggagtttggggccagggaaggcaattggggccgcctggcattcagagagctgaaagcagctgaacctggcttggcagatctgaaaatctgggtctggggtggaaccaggtacacacacacagacacacacacacacacacaacacaccccttgtgtgtctccttgacttcccccttccctccaagacatacctgttcctccaggtccccactgccaggaggcaaacttcctcttctcagtttgttttttgttcccctccagacttcagcctctggagctatctccagggcaaacaggagggctgcctgtgggaaggctggggaggacacccaggaatagaatgctctctggagcagggcagagccctagggcccacagggaggctccgcaggagcacagagtctggaatcagggcacagcaagcatttgcgaggtgaacggaagaacattgtcaggcgctgagacgcgttctcagggtcctggggagaaactccaccaggcagccccaagctgggaagggcacagagcgggcaggcctcccccattctgtatgcaggagactgaggcctagcagaatggtgaggggataagcaccccacctgtcagggcttccttgggccagagatccttctgggggccactgctgggtgggcaggcaggagtgggcttccagaagcctctggccctgcccccagcctctctgtgcctgtcctttgtcccatctctctggctcatctcaatgcccttgactcagcggaccacgctcttcactgtgttgtgtctcccccatccccgccccctctccggctctgtcttctctcttagttgcgtacttgaaggaccgaaggctgagtggaggagcaggtagccccacggcccttcccctgatgcatggacgcccagcctcctcctcccccgctccttcctctgcgcagtgtgctgcagccaggccgcatcttgctgtggtttggaaccttcttgtgtcctgttcaactcagaaaccccacagattcttgcttttctgcagacttggcctctaggttggctgggttgcagagcagtcttgcttctaggttgtcatgagctgcgtggcttccagagctctggggataggaaacagaccctccttagaggtagagcccaggcctggccctgcctgagccacataggtggccaggagagttccggagggtagagtttgctgcccgcaagtcttgcttgtgaaactctgaattagggaattagggcacagtctgaattgagggcagtatgcgaccaccgctccgcgtcctcctttacagaaacagtcctacttctccactggcatcctcttgagggaggcacagctggaaacccagcacctccctgcaccagctcagggctgcctggtcagctgctggccgcagccccctaggcccactcactgtcgccggccctgcatgcccccagcccgacagctgtcgccagcctcctgactcaggaggagccctttgtgccttcgaggaacggttcgctggccgctttgcttgcagcctacttttcccaccagaggcacctggccctgcccgccagtcctcaggcccatcctgtctctgtccacagtgccctcagccagcatgacccgcctggcacgctcccgcactgcatccctcaccagtgccagctcggtggatggcagccgcccacaggcctgcacccactcggagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggccattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattccagtgtggtgatgccatgcccatcatgggaggcttttggagaaacagaatgtttgggcaggggctgctggtgctgcttgggttttgggttgagggtgctaggagaggatggtctccacccatctttctatttccagtacacgtcacattattttaccggtgagatgagaatgtcacaaacattaaaagccttatgtgctcat

SEQ ID NO: 13067 - DNA, 7560 bp, Homo sapiens
aagattttaagatgtttaatactcaattttgcacttcaaaaatatattaagagctgattctgttgaaagagcgtgtgtgtgtgtgtgtgtgtgtgtgtgtgtgtgtgtgtgtgtgtgtgtgtgtgtaggggtggaaacaatgatagagattctaaataaatccaagaactgtgaagggttcagtgagaggaggacaggcaggggcatctggacatgggtgtgcatgcacagacccggctgtagccgggtggctgatcagcagcaccttgaagactttacagagtgtttctgccatctgcacccatcctggccccgcccggccctgtttcccctcttactgcagctcatcttccccgacctggtggaggggctggtgctggtgaacatcgaccccaatggcaaaggctggatagactgggctgccaccaaggtgtgtgtggtgaccgggggtggggtgggtatacctagggtggggtgaggggcggcactcacgctggcgccctgctccctgcagctctccggcctaactagcactttacccgacacggtgctctcccacctcttcagccaggtaagggggggaacttctgcagatctggggtgatctgggatttgcccctcccagctggctcggtaggaggcaggcgggtgtctttggcatctgacctggctcactccagatgctaagccatctgaaagacagacatcccctcccaaggccccacacctcctacctgcccccaccctgtctcccctgcctgctgagtggggcaagggccactctggcagtgacatctgccagccccctctaagcctgcgtccctctgtctgcccctctgcatgcctccatccatctccctgggcctaggaggagctggtgaacaacacagagttggtgcagagctaccggcagcagattgggaacgtggtgaaccaggccaacctgcagctcttctggaacatgtacaacaggtgcgggtgggatcagcagccctgggacccagcacaccccagtgggggcccttgcacactgccccctgagggaggcaggcagacaacacccttgccctggtttgtagatgggcacgatattgggcctcaaaggaggtcatttcctgcacaaggtcacaccctgtgaggggcagaggggaacagggtttcagactccgggccttgggctcttccacttttcctcctcccctgggggcttcccgcttgggaatgttgggggtgttagtgacatccctgactccagtaacccagccttgatgttgacgtctgcaaaatgaggaagaggtcggatgagcctgtggttttcaagctgtgctccttggagccccctttaggggctgccctgccctgcaggaaggtggccaggccccctcactcacgtgccctccttctcattcttctacaaatattaagcacctgctgtgtgcatggtgctaagaaaacaatagagaatagagagacccagggcctgccatcccatatggtccaggagacaggccagtagcagaaactcccacagcacaggtggcggtgcgcatggctctgagggggatagagagcaaaatttgagagcccacctggtatgtgctagggagtccaaaaagccgtgacagggagcctccagttcatttatgcagagcaggtccacgcctccctgctttaccaattggcagtgttgggcttgggatgcccctcatcctgtcctggggtgcccacctctgcctctgcccctccccctgccccacagccgcagagacctggacattaaccggcctggaacggtgcccaatgccaagacgctccggtgagtggcccctggccctctggcctgccctggcctttgcccccatgacccagccagacagcccttttcctctgtatctgcagctgccccgtgatgctggtggttggggataatgcacccgctgaggacggggtggtaagtgaggggctgtgggctcactgggggtgggaggtaggggtgaggggctcactggcccctgcccagcagggacaattcttgatccagcccaggggagcctccagggccagcagtggacggtgggcttcttgtccactttcccacagtcttgccaagcctcacatctggcatagcccccatccttctggctggggaggcctggaaatggggagagctggggccagggctgggccatcagaaggtcccctcttccctccccagcagcacagccccaacttggtccctacccacctcaggcccagggtgtacgatcttttttctaaaatgtgatcaagccattataaatcattaacgcatacagcggcacggtctcccttttcccgtcacctgcagcggttatgtttgggggccgtgtgtcacctctcctgctggaactctgggagcaggtggcctgaggctgggatgccccatcagcacagagctgctgggaagctgcagggtccagaagtgcccagagcagccccgtgcgccctgaaaataccaggctttcccatgcccactgggaggtcctggaagagcagggtggtgggctgtgccagccccctccacccagtctctctcagaccctcggcacccctcacctcactgccgagggcactggggctttcccaggccagtcccaccacggcagcccagccctcgcctgactcccactcctagcagttgtgagtgggctccaagggtcccaggcccttcagtggggctgttaaactggtctccaagaacatggggagccctgggagaagaaagcctgggaggagcagcctgtcacagctgctgggcctccctctgcctccctgcaccccctctcctccccgagcttggggcatcaaacctgccttggcaatgggggtggggaggggcaggggctgttgctgaagctggctccttgtcctcaggtggagtgcaactccaaactggacccgaccactacgaccttcctgaaggtgaggctttcttccccagccctgggccagcttccctagcatgggcccaacctcagggaggtgttttcctggggtcccagccagggtgggagcttgtcctggagtgagggccctgctcaggtcaccccactctctcccttgcagatggcagactctggagggctgccccaggtcacacaggtgagacttttggccctcctgcccttacatctatggggagggggaagcctctaccctacctgctaatcctaggcagccaatgaaagcatgtgcttgtcctgccctccgcagccagggaagctgactgaagccttcaaatacttcctgcaaggcatgggctacagtgagtacatttccaccccaccccacaccacctagagaccggtgggcaggcagtgctggggttggggctcctgtgtgcagggctggcacgtggtgtcaggtggtagtagggagcccataagcataggagttttgtgtgacctgggccccggatgctgggccccacagatgccacctgagttgcaagttggccatcccaggctgtgcccaactcccctttgcccttagggaggacttggcgcactgttctgatggcagtgctgggcctactgggggaagggactcttccttccgtgctgggggtccaggccagggccgtgtcctgccagggaagcctgtctgggggtgaggcacactcccctcacccgccccagggcttggggtcagagctgggtctatggcacctgagaaggccttttgaaacaactcatggctgcacccaggggcatcataggagtgggcttggagtttggggccagggaaggcaattggggccgcctggcattcagagagctgaaagcagctgaacctggcttggcagatctgaaaatctgggtctggggtggaaccaggtacacacacacagacacacacacacacacacaacacaccccttgtgtgtctccttgacttcccccttccctccaagacatacctgttcctccaggtccccactgccaggaggcaaacttcctcttctcagtttgttttttgttcccctccagacttcagcctctggagctatctccagggcaaacaggagggctgcctgtgggaaggctggggaggacacccaggaatagaatgctctctggagcagggcagagccctagggcccacagggaggctccgcaggagcacagagtctggaatcagggcacagcaagcatttgcgaggtgaacggaagaacattgtcaggcgctgagacgcgttctcagggtcctggggagaaactccaccaggcagccccaagctgggaagggcacagagcgggcaggcctcccccattctgtatgcaggagactgaggcctagcagaatggtgaggggataagcaccccacctgtcagggcttccttgggccagagatccttctgggggccactgctgggtgggcaggcaggagtgggcttccagaagcctctggccctgcccccagcctctctgtgcctgtcctttgtcccatctctctggctcatctcaatgcccttgactcagcggaccacgctcttcactgtgttgtgtctcccccatccccgccccctctccggctctgtcttctctcttagttgcgtacttgaaggaccgaaggctgagtggaggagcaggtagccccacggcccttcccctgatgcatggacgcccagcctcctcctcccccgctccttcctctgcgcagtgtgctgcagccaggccgcatcttgctgtggtttggaaccttcttgtgtcctgttcaactcagaaaccccacagattcttgcttttctgcagacttggcctctaggttggctgggttgcagagcagtcttgcttctaggttgtcatgagctgcgtggcttccagagctctggggataggaaacagaccctccttagaggtagagcccaggcctggccctgcctgagccacataggtggccaggagagttccggagggtagagtttgctgcccgcaagtcttgcttgtgaaactctgaattagggaattagggcacagtctgaattgagggcagtatgcgaccaccgctccgcgtcctcctttacagaaacagtcctacttctccactggcatcctcttgagggaggcacagctggaaacccagcacctccctgcaccagctcagggctgcctggtcagctgctggccgcagccccctaggcccactcactgtcgccggccctgcatgcccccagcccgacagctgtcgccagcctcctgactcaggaggagccctttgtgccttcgaggaacggttcgctggccgctttgcttgcagcctacttttcccaccagaggcacctggccctgcccgccagtcctcaggcccatcctgtctctgtccacagtgccctcagccagcatgacccgcctggcacgctcccgcactgcatccctcaccagtgccagctcggtggatggcagccgcccacaggcctgcacccactcggagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggccattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattccagtgtggtgatgccatgcccatcatgggaggcttttggagaaacagaatgtttgggcaggggctgctggtgctgcttgggttttgggttgagggtgctaggagaggatggtctccacccatctttctatttccagtacacgtcacattattttaccggtgagatgagaatgtcacaaacattaaaagccttatgtgctcat

SEQ ID NO: 13068 - DNA, 427 bp, Homo sapiens
aagaaaggaagcaagcaagcaagcaaggacttgggtaaattatatggggctgaactaagtgtattattctgctctggctgccataacaaaatacaattgaaattaattttctcacagtctggagactggaagtctaagatcaaggtgccagtagggttgatgtctgatgagagctctcccctcgggctgccttcccactctgtgttcttgtggcctttccttggtgcatgggcatgggggagagatagtgcaaactctttggtgtctcttcttataatgatatgaattctgttggatcaggaactcactcttatgacatcatttaacttcgattacttcctttgaggcctcatctccaaatacaagcacactgagggatgagcaacactccaactcaaaaaaaaaaaaaaaaagaaaaaagaaaaaa

SEQ ID NO: 13069 - DNA, 98 bp, Homo sapiens
caccaccacgcctggctaatttttgtatttttagtagagatggggtttcaccatgttggccaggcttgtcttgaacttctgacctcaagtgatccacc

SEQ ID NO: 13070 - DNA, 1930 bp, Homo sapiens
tttcagagatgttcaaatatgaagtgaattttgaattgaagcaatactatatttgtgcacatgccacatgatatacaagatgaactactctagcaattgtacaagatgaactactctagcaattttttattctgcccaaagaaagagatgggaaacaacctaaatgtccgtcaatatatccctggttaagtaaatttggacataacctcagaatggaataaaatgccactttaaaaaataatgaggaaatacagtggtttggaagggtcaacatatgttcttaatgagaaagcaatgtataaaccagtaaatataatatgccgacttctgtgaagaaataaaacaagtaaacccagatttatatgtgcctgtgtacacgtaaggaaactagaaggacggaaaggaaactgtggctattagaggtcatcgttggtactggatggaggaaaacaagaatggaaggcttttcgctgtatattttatatattttttggcttgtgaatagattttttaataccaaaaaaactttaaaaattaaaaattgaaagaaaaaagtccagaaatttgacgttcttgaaaacatgatttatcacataatatatacatttactttgcttgtcacttgaaatgcctaagaaaacacaaaatcaatcttaaactagaaacttctattgaatatgacatgaagagagcacatattccgacaatttcaagttcttttcatagccttccagtcctaataactcagcgttaacatcttattctgttcagcactatttgataatttctttcatcctcatgggctctagtattgatgtttcatcagtctcaattttataaaaccatcctttactttgtaataaagcaatgctgagagacattttccataatgcagggggaaaaatgtggatcaatcacaaactcaaagaacgttacagttataatgctttcgacatttttttctacttctgtgatgctttttcaagataagcttccccctccccctttttttcccctccacctgtgcactgtcttatcgcgatatactcttgacttctgaaaatcaagttgcaggattggtatgactggaatgcagaggttctcttgaagtagtgtcaccacataactattctctattgataaacttatcgcaaccaagttcttctatcagagggttgataacttcagaggcagtcagagctatcgtaaaggttaaaatatcgaggtccaccctgtgaggatttcgctgatattcggcatcaaacgctgcttcccttgctctgcaggcttccacgaatcgcctgcggcgttcttcaagctcttgtattctgccgggagcaatcgggtaattttccagatagtggcggagaaactgctggtaattgatgcctaaaacgctaagtgggtggcggagacggagatagggcaacgcagccaggcctccgttcccgtgtctggacctgggcctgccctcgggaccctcttcgtccactggctcccccagcaagcgggcgacctccgccatccgggcttccctggccgccgccgccgccgggctttccctgcccgccgcggctgccctggccaacgccgccgctgccaccggggctcccctggctgccgccgccggggctgccctggccgccgccatccgaccttccctggccgccggcaccgggcctcccctggccgccgccatcgcgccttccccggcctcctcaggctgtgccggggccggctcccgcctcccgcggcctacctccgcctgcgggacgtctctgtcaccattcgccgcgcctgtctgcgggacactgctgtctgcgggcagcttggacatctcagaccgtggggtcaactcggctgctcccagagaaactggaataactggacagagcgatgcccggcggacaccccagtgcgcgtgcgtggg

SEQ ID NO: 13071 - DNA, 128 bp, Homo sapiens
ccagctactcaggaggctgaggcaggagaatcacttgaacctgggaggcggaggttgcagtgagccgagattgcgccactgcactccagcctggcgacagagtgagactccctcttaaaaaaaaaaaa

SEQ ID NO: 13072 - DNA, 126 bp, Homo sapiens
tttttgtatttttagtagagacgaggtttcaccatgttggccaggatggtctcgatctcttgacctcgtgatccgcctgcctcggcctcccaaagtgctgggattacaggcgtgagccactgcgcc

SEQ ID NO: 13073 - DNA, 980 bp, Homo sapiens
atgagaaccactgccttgtgacctccagtagaatgaggccccagtgttgactgcactggaagagtccaggagcttgttaaaagtgcagatagactgattccaccccagaatggacaccgagaaatcttggatcccaagagtttggttggctttatcatgccccttagtcatttctgagtggttcctcatactctgcatccatgtgatgagaggcaaatttcctcatgatctgctttgcttcctcatcaagctactatgccccaccattgctggctctgcttatggttgctgcaatgtaggcagcgctgtttcttgttcttaccacttttaactatcttaaaatagaacctgactctgattctccattaagaagtggaaactggctgggtgtcgtggctcatgtctgtaatcccggcactttggcctcctatctgaggctaaagcagggggatcactagaggccaggagtttgagactagcctgggcaacatagtgagaccctgtctctatcaaaaatttaaaaagttagctgggcgtggtggtgcacacctgtcctctgagctctcagctacttgggaggctggggcaggaggaccgcttgagctgtgatcatgccactgcagtccagcttgagtgacagcacaagaccctgtcacaaaaaaaaaaaaaaaaaaaaaaagtagaaaccatcagctaactttagaaactttccctgtagggttagatttccttacaaggtaaggtactttctaacacgttctcagccctccattagcaatacagaaatccccaccaaccccaccctcacttccttccctcacccctaggaatactcaacaattccaaggtccaagaaaggaatttattcctgtcacctaaatccctacagaaacattctcactcttctcataaaagcaataaaatctgcaggtttaaggcttagaactttgatccaataaaagttatattactataccaaa

SEQ ID NO: 13074 - DNA, 980 bp, Homo sapiens; identical to SEQ ID NO: 13073

SEQ ID NO: 13075 - DNA, 980 bp, Homo sapiens
atgagaaccactgccttgtgacctccagtagaatgaggccccagtgttgactgcactggaagagtccaggagcttgttaaaagtgcagatagactgattccaccccaaaatggacaccgagaaatcttggatcccaagagtttggttggctttatcatgccccttagtcatttctgagtggttcctcatactctgcatccatgtgatgagaggcaaatttcctcatgatctgctttgcttcctcatcaagctactatgccccaccattgctggctctgcttatggttgctgcaatgtaggcagcgctgtttcttgttcttaccacttttaactatcttaaaatagaacctgactctgattctccattaagaagtggaaactggctgggtgtcgtggctcatgtctgtaatcccggcactttggcctcctatctgaggctaaagcagggggatcactagaggccaggagtttgagactagcctgggcaacatagtgagaccctgtctctatcaaaaatttaaaaagttagctgggcgtggtggtgcacacctgtcctctgagctctcagctacttgggaggctggggcaggaggaccgcttgagctgtgatcatgccactgcagtccagcttgagtgacagcacaagaccctgtcacaaaaaaaaaaaaaaaaaaaaaaagtagaaaccatcagctaactttagaaactttccctgtagggttagatttccttacaaggtaaggtactttctaacacgttctcagccctccattagcaatacagaaatccccaccaaccccaccctcacttccttccctcacccctaggaatactcaacaattccaaggtccaagaaaggaatttattcctgtcacctaaatccctacagaaacattctcactcttctcataaaagcaataaaatctgcaggtttaaggcttagaactttgatccaataaaagttatattactataccaaa

SEQ ID NO: 13076 - DNA, 338 bp, Homo sapiens
caaatagaaaagatttacaggccgggcgcggtggctcacgcctgtagtcccagcactttgggaggccgaggcgggcggatcacgaggtcaggagatcgagaccatcccagctaaaacggtgaaaccccgtctctactaaaaatacaaaaaattagccgggcgtggtggtgggcgcctgtagtcccagctacttgggaggctgaggcaggagaatggcgtgaacccgggaggcggagcttgcagtgagccgagatcccgccactgcactccagcctgggcaacagagcgagactccgtctcaaaaaaaaaaaaaaaaagaaaaaagaaaagatttacag

SEQ ID NO: 13077 - DNA, 337 bp, Homo sapiens
caaatagaaaagatttacaggccgggcgcggtggctcacgcctgtagtcccagcactttgggaggccgaggcgggcggatcacgaggtcaggagatcgagaccattccagctaaaacggtgaaaccccgtctctactaaaaatacaaaaaattagccgggcgtggtggtgggcgcctgtagtcccagctacttgggaggctgaggcaggagaatggcgtgaacccgggaggcggagcttgcagtgagccgagatcccgccactgcactccagcctgggcaacagagcgagactccgtctcaaaaaaaaaaaaaaaaaaaaaaagaaaagatttacag

SEQ ID NO: 13078 - DNA, 338 bp, Homo sapiens
caaatagaaaagatttacaggccgggcgcggtggctcacgcctgtagtcccagcactttgggaggccgaggcgggcggatcacgaggtcaggagatcgagaccatcccagctaaaacggtgaaaccccgtctctactaaaaatacaaaaaattagccgggcgtggtggtgggcgcctgtagtcccagctacttgggaggctgaggcaggagaatggcgtgaacccgggaggcggagcttgcagtgagccgagatcccgccgctgcactccagcctgggcaacagagcgagactccgtctcaaaaaaaaaaaaaaaaaaaaaaaagaaaagatttacag

SEQ ID NO: 13079 - DNA, 5335 bp, Homo sapiens
gaaggactgtttagtgctacccgtcctgagcaccaatgggtcaagccagtgctcttgcttccctcctgctgagagcactggccttggtcctgggtgccaggattgggaaggggggcaaaggggaatgattatcatctccatagctgcccttcccagcactgggtgccaagagctttacattcactaatttaatcccattaacaactctataatagagtgggcacttctgtgccattctacaaatgaggattcggagactcgaacagcctcagagtaacctgccccagttacacagttagtgtgttacggatttgggtctagaatccaaatgagggctgttgggtcacaaaacacctatctccatgattagatcaatgttctcaaacttgaacgtgcattcaggtcaccaggggagtcttgtcaagatacagattctgatcctgtgggtctgggctgaggcctgagcctcagcctttctgacaagctcccaggagatgcagaggttgcgggtcttagaccacacttggaggaaccagatgcagtgttgcacccctcttctatgtccacgaagtgtccacaagtgagagaaggccgagtacagaaaaaaggagaaggaggaagaccagtttttcccttctgcaaaatgttgttctgtcccctgatgcaggggtccccaacccctgggccgaagaccggtaccagtccattgcctgttaggaaccaggccacagagcaggaggtgagcagtggacaaacattaccacctgaactcctgtcagatcagcggtggcattagattctcatcggagctggaaccctattgtgaactgtgcatgggagggatccgggttgcacgctccttatgagaatctaatgcctgatgatctgaggtggaacagtttaatcctgaaaccaatctatgaaaaactgtcttccacaaaaccagtctccacggtcaaaaagtttagggaccactgccctaatgtatacctgacaatcaagaaacccacagccaagagctttgctcccatgaaagctcttaaccagcaactaaattcagtttccatgtatctgtcagagatcttttccagaacacttgggcctcaacagactggcccaattttgcactttaggaaatcagcctccaggagtaagaactggtacaactcccttccccaagatgaaacccgaggacacagtgatagtcacaactgggtcagcccaaaagcttgcatgtggtctgccacacacacactgggagaaagcgaatgctgcctcctttaaggacacctcaggggcatccaaggtcatccacgacagcctgatatgggcctttcagctcatgactttcacctgggattggttctcatttctaagtggcacttcctcccccgtggagctttctggggacacttcatggaaggtgcgttttattttcatggagagcatcggggtgagtcttgagagtgaggttaggactctcaagagggacatggcagggatgtctggtggcagctgaagcttcagccccacacacaggaccagaagtaactcggagcacagccatatgccaggcccgccaggagccaacactgcccctcctgccctcctttcctgcatttggttccctccctctctgtgggcatcctccctcttccctacacccagaacgtggaactgggaagtgcccggcacagaccccatgccctcgtccttggcatgagctcacccttcttaaagaaaacatgcagtgcagtgaccaccactaaaaagcatggtgaagactgggcaagagacatgatgttttcatcctgagtttcctcagcctgttgctggaaactttagggagtgattcttccatgaaatcatcatccattcattcagcaaatactgaggacctactaggcaggaggcactttgctaggcctggggctatggagatgagtgtaacacagtccctgggcctaaagaatttagcatgtagagggggacaaacagggagtaaacagcgatggcacattctcataagtgccgtgagaaaggcatgttcagagcagagaggagctggacgagagggcacccacagtcactgagcactcactctgtgccagacactttacatccatttctttgatgctttccaatattgttcacatcactgctcatctggaaaatgagaatagccctgagaccaaatgaggtaagctcaggaggcctctcttagctggaggccccctgccccggctccagcccatctcagcaatcctaacccatcctcaggtatgctactgtcccatacagccagggagggatgagttacgttacaccatcaactcctcacaactctaaaaatggtgaaagaaggctgcatgagtgtaagcagctggttcaagctgtccccgttcatgagaaatgagattgagatgccgacccaggcttgttccacagtaacagggttccccgttgcattgcccccagctctgccttgcttgaggagtggacaccaggaaagggatctggacaaggagtttcgctgcaggagaaggaaagagcagagatttccaagcataagaaacagcacgtgcaaacacacagcaacatcaaacaagtttttccatatcccagattaagaactgtggaatagtattcatttatgtgtgacaagaataaaaggaaattgttttgctgagatggcttaaaacctggatgacgggttgataggtgcagcaagaccccatggcgcatgtatgcctatgtaacaaacacgcacattctgcacaacatgtatccaaaacttaaagtaaaatttacaaaaaggaaattattgcaacacagttactaataattgcttccctcttcaccttttaaatagaaaggacactttgctcaggcaggttagcttttcagttctgttccactgactaacagatggattggagcatgtcagatgctgaagggcaggcctaatccaggtgagatgggtaggtcaggggagggaaggaggagagtttagcaggtgggaacagaggaagaatcatggggaactggaagggcactgagaaagagagggagaagtagccacagaggctcttgaagagatgtggggaggttttgcagggttcttgtgtgttgaacagtcaagagaccctcagccaaggcctagcagagccgttctgggtgtttagatgtccatgcttgtttctctgagccatatcaccgtgctgaaaatggcctgggggcaagtctgtacacttgagttgtacatttgatccacaaacttgctttggagatcctactccgtccaactgcggtgctgagcagcaggaatacagccctgtcatccatgtgcttccggtgaatccagggcacagacaaccagcaggtgctctgatgacagggtgaggcctttcagacaaaagggacagcacacggaattattcttgactctttctgtgctcacagtccacatccagtccgtccatgaactatgaagctgtttccactttggggccatgatgaataacgctcctgtgaacacgagttttttgtgatgtgatgttttcacttttcccgggtgtgcagctacgagtggagttactgggtcacatggtgcctctgtgatctgtctgcacatactccatattttacttattaattttagttctatcctatcctgttttctcacctttgctaaaacgcaaacctcatgaaggcagcaaattgttttctgttttgtttgctgctatatctccagtgcttagaaaataagtcctcagtaaatatttctggaataaatgactgaataaatgtacagaggcctgagggtgaaacatccttttgtattcaggaagctgcaagtcactcaggatgactggattgtaagatacaggggcttaaagggcaatgctgaggttgtgcatagggaacaggtgaacttaccaagaaccatgggccttaggcatgctctcttaaccaggagagcaaccagatccatgggggcaatttgtgttgcaggttgtgggattccagctcaagttagcctaagcaaaagagggattctattggttcccaagacttaagttcaaggtaagcagttgcttcaccccctgtgagatccagagatgaagatgattctctttctccctcctcttccctttctctttctctcagtcccttcttttctctccctctctcctgtggcccctcctccactttccactttcctgaattcatttgattcctgcctgagttctctcctcgcagtggcaaaatggtcagtggaagttccaggctttcatcaccccttcagcctccagcacacccagaaaaaccagggtgcccactctttcccccacatccgtgggcatctcccggaaggtctttgatgaaccccagttaggtctgaatcttgtgctggatgagtcacagggacactatccagccacagtggctggtcccagtagttgagggaccctgagaattgtgtggaatgtggtgatggggagtgtgcatgcgggtgcacacatatagggtatttgtgtgtgtgcaccgtgtacatgcaggggtgtatgtgtgtatgtgtattagggtctgggtgtgggtgtggggtgtgttcagggagtgtgcatacacgcatgggtgcctgggtatgtgcacgtgtttgtgtgtacgtggagtgtgtgtttgtgtgtgcatggtgtgtgtgcatatgtatgcactggtatgtgtgcatacatggggtgtgtgtgcatatgtggaggtgtaggtatgtggggagtgtgtaggtgtacatgtatgagtgcatgtgcgtgtgtgtgaaggtgtgtgtgtgtgtgtgtgtgtgtgtgtgtagcagtggggttggggaggagacagtctccagaaggaaagtgggggcctattagcagcagtgtagggatggggagctgggcagtcaaacccttcgagtcctgatgcagaacctaatcagagctgtgtggctgatggatgaaatgacaactcagcacggatggtggcgaggagatgtgcagagggacattaagaatgggagcacctagtgacagatgacacataaaacatggcccaagcaactcctggggagctggctgaagggacttgatgtggcccgatatcacagagtgaactaaagaataatggaatagaagcagatcttgttgaatggctttggtttcctggttttgttaacacatattctgacttactttcaatttaagtcgaaaggacctgcctgaaaactgtgatcagtaaacagcctggtcatcagagccgctgtaaagggaccgaagacacacagtccctttctctttgaggctcg

SEQ ID NO: 13080 - DNA, 15057 bp, Homo sapiens
  misc_feature (6999)..(7000): n equals a,t,g, or c
  misc_feature (7031)..(7031): n equals a,t,g, or c
cagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaatgatagtcaagttaaaaatattttttgagggattaatgggagaagggccggggttggggtggggggaacataaaatgaacagtatacatttttttattttttgagacaagagtctcttgtttcccatgtttcccaggctggagtgccatggtgccatcttggttcactgcaacctccgcctcccgggttcaagtgattctcctgcctcccaagtagctggaattacaggctcccaccaccacacctggctaatttttgtgttttttttagtagagctggggtttcaccatgttggtcagactggtctcgaactcctgacctcgggatccacctacctcggccttccaaagtgctgggatttagaggcgtgaggctattgcacctggccctggacacatttttttttaaaccatatttttagagttgggagaaatgttctttactacgggactaggcagtgcgcactggaaataccatgtgcctgcaaagtgaaaatagaaattgatgcgtggatacttagccataattgtatagccatcacaatcttgtaatgaagtcgcctacatgctgtagacagttgacttccattttgtgtgttttttaagagcaatttgagtttttgagaatggcaccattagtttacatggttttggggttaaaagtcttactactaaaaacagtaaattatactggccgcagcagaggtgcttgcagttacatttagccattattaggtatcctgacttcagcagtcagtggagacattgtataagaataaacatcccttgagtcaacactttattacacactggtgcagtaatttgcagttatttgttctatcctttgttctctttttttttttttttttttaagtgacagggtctagatctgtggcccagggctagagttcaggggcatgatcatagctgactgtagccccaagctcaagagatcttctcacctcagcctcccaagtagctagaactacaggtgtgtactaccacacctggctaatttttttaaaaaattttgtagaggcagagttaatctccctgtgctgcccaggccggtcttacaattcttagccttaagcaatcctgcttcccaaaatgctgggattacaggcatgagccaccatgccccagttatcctttgtcttttaagaattccctctttgttacttacaggttaggtgtcagacaccactagttgagttaaattgagggtaatatgaactgccagggagctatgaatattattgaaggataagtggtcttagagaagagaaaatagttaggattcatttttcctctggcctataaattctcattgggttagcactttagattaacacattcagatggtattcaagttattttaggaggaagtgataatgttagtgaagaggttaaattttgtaattttactttgagaagctttcaggattgagaacagtttgtcttactaatattttgaacagtccttccccctttaagatttcaaaagcaggtcctaattagttttggccactcttgttaagtgttaaacattcaataactctcttagagggcatggtatttactttgttaggaaaaattatcttttttattgcaaaataattactaattggtaattattactgatgtagcctgtagtctgcattttctttttcatagacttcattagagcagttttaggtttacagcagaaagcacagaattgccatatgacttctgccccctacacaggcacagccttcctcactaccagtatcctgcactggaatagtacatttgttaaaattgatggacgtagattgattacctaaagtccatagtttacatgaggtctcactctagatgtatgttctgtgggtttggagaaatgtataaccgtgtttccatcatagtattatacagaatagtttcactgccctaaaaatcctctgtcctgtgcttagtcatccctccccattcaaccactggcagtcactgtctccatagttttgccttctcagaatgttacatagttggaaccatacattatgtaaccttcacattggcttctttctcttagtaatacatatttaaagttcttctatgtcattttgtggcttttaactagtttctatcagttataatattccttctgtatgtgccacaattgtccattctcccattgaagaacatcttggtttcttccaatttttggaaatttttttgtttttcttttgagacagagtctcgctgtgttacccaggatggagtgcagtggcacgatctcggcttactgcaacctctgcctcttgggttcaaccatttctcatgcttcagcctcccgagtagctggaaccatagttgcgtaccatcgcacccggctaatctttgtatttttgtagagacggggtgttactgtgttggccaggctggtctcgagctcctgacctcaggtgatctgcccgcctcagcctcccaaattgctgggattacgggtgtgagccactgcgtctggcaaatttttggcagttacaaataaagctgctattaacatctctctctaagtttttgtgtgcatgtaagttttcaactctgggtaaataaggagcaggattgctgggtcatatggaagtgtgtgtttagttttgtaagaaatcgccaaactgtctttcaaaggggctatacccttttgcattcccaccagcaatgaatgagagtttctattgctctgcattcttacctgcatttatagtgtgttggattttggccattctaatagttttgacttgcggtttccgaatgacagattatattgagcatcttcatgagattctttgccatctgtatatcttttttggcaaagcatctatttcaggtctttcaacatgatccagcagttctgctgcttgatatttacccaaggagttgaaaactttttttttttttatattctgacattcttctaatggattgtgatttgagttaactttgtagggtggggtggtggtatcttagaaatggaactctttggaaataatacaggggggtattttcttccccctaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggtaaatatggtggaattacaggcatctaaatcagactaacaaatttagtcattttagaatctcaaaatagttttacaaattggaggagactttggaagtccatggaatccattcaaactaaaaccttttggttttagtgatgttggcagttttctaagtaaaaatgaaaaataattgaatatctgcatctttaaataaaattatttgactgcctgcatggggctttctcttgtccttcccacattaatgataaatgatattccaactttaaatgaatcataattgtatgaaagtcctatttttatattgacttatctaattttttaaggctatggaagaaatgaatggcaaagacttggagggagaaaatattgaaattgtttttgccaagccaccagatcagaaaaggaaagaaagaaaagctcagaggcaagcagcaaaaaatcaaatgtgagtgaaatttgtatacttaaaaattgtataaattttaatatttatacactaattggaaaataacaggtgttgatcagacttgttaaatgcataacatctctttaaagaagacttgaacgtttgagagtcatagggaaacaccagtgatctaagtgtttattgaactcttactatgaaccatatttgtgaaaataatcagaattgtaaataactggaattttggtaaattggcaagatgaaaaatctgtctagctttttttttgttttgtattgggtgacagagtctcactttgtcactcaggctggagtgcagtggcactctttcggctcactggaacctccacctcccgggttcaagagattctcctgcctcagtcttctgagtagctgggttacaggcgccaccatgcctggtaatttttgtgtttttttttttagtaggggtggggtttcgtcatgttggccaggttggtctcaaactcctgacctcaggtgatccgcccacctctgcctcccaaagtgctgggattacagctgtgagccaccatgcctggcctatctcacatattttctttgtattttacagaatgttcttctgaaaatgtcttaaatattagctgtccaaatatcttaatacattttgttaaagggtggagagttttttctctgagagataggaaatactaaatctctattcatgatagactgtttcttcaccagtagtgctcattgccaccccaaaaatttcatgttcgatggatggattttgaaaatgaaatgagtattaaaattataacacagtagtgcaataagaaaacaagtaggtgtgtaatgagttatactaattagggagacctttttagagaatctgtaaataggtatctgcttaagactgaaggaaacttagttgggtaagaattgaagttagctcctaaaaagttagttactgatttcctagaagaggggtaattgttcttgaatgtgagagcaataatcactgtcaatactattcaaggttaattttctgttgattgccctgtttggaatttaaaggaagaggatgcttctacatatttctgttacttcataatcagggaattgatcaagttctagtttctgcagttaattgtccagttggacaagttggcaagctctgaacctcaatttcttcagttctaaaatgggatcagacaaaattatgtaatagctctggattatgtgattatccaagtgacccatgcttgttctgggaccaaagaaaatatactttgtaggtttgatgatagtgtaaatgaaggaagactacaaaaagagttagttttaatgctctatatttcaaacacctggatatactaaacagtgtaaaataacttctttttatttctttcagaagacgatatatggttaatttattaaagtagaatgtaagtataggagattatattagataatgtgattagagcagttacatttggtacttgatagagggagatactaaatagaaggtggaggatgtcagtatatctgttaatatttgaaaaggagtacaaactaaaagggatgattgcatgttactttcgtactttaacttgctacagtctttttttttttttttttaagttttaactaagcacgtattcctacataattctcactgtattcctgtgagttaggtactctatcccttagtttgaaatgaggaaactgaggctcagaagtcaacttccttggggtcattcacatagtaagtagtggagttggatttgaactaaggtagtctagtctcccataattttccctcttaaccactataccaggatttctcatctctgtcctcctgacattttgggctggataattcttggtcttgggggctgccctgtgcgttgtaggacttttagcagcatccttggcctcttcctgctagatgccagtagcaccccctttctcagttatgaccgtctaaaatgtccccctggaaagaggtggtggcaaaattatccctggtgagaactatttagaaatagaaaaggatgatctttccatcatttcctcaaaacaataaaccagcagagcacataaaaggtctaaggacctagtgaaccggaataacatttttacgttagtcagttggaacaggggcctttaataattcaggataaaataaggccgggcgtggtggctcatgcctgtaatcccaccactttgggaggctgaggtgggcagatcactctaggccgaggtgggtggatcattcgaggttaggagttcgagaccagcctggccaacatggtgaaaccccatctctactaaaaataaaaattggctaggtatggtggcacatgcctatagtcccagctactcgagaggctgtggcaggagaatcacttgaacccaggaggtggaggttgcagtgaggtgagattgcgccactgcattgcagcctgggtgacagagcaagactgtgtctcaaataaataaataaataaaataacataacaggtacggaataaaaaacacgagtaaattattccttcaagagggattaatttccatatttcatgggattattgggctcaaaataatcactaagttttaaggaattgtataaaattgtactgtagggaacatgagttggaatattgtaacttcgtttagtccttttacatagtatgtaagcatatgctgatttgtgtggttgctttctaatcactttgacaactaaagttatacctgtttagtggttaaagttcagcactatagttacggtgtagtttatttttgggaaagtagcagatcttttaaattttacttggatagcattattgtagaaacaggaaaactttaaggtctttatgctaatttactgtagtaaactttgaacttcacacattttggttgtgtgcttgtcctacttgccattttgcttttgtaataaatgttcttcaagtatattggaatagaatcttagcagaaatgcaattcaaagtgacaaatttttttttgagtcagagtctcgctctgtcacccaggctggagtgcagtgatgtgaccttggcttagttttttttggggggccccccccaaaaaaaaaggggggggccccccccccatatttttggnnccccccccggggggttccccccccacaaaanttcccctttttggggggggggggttttttttccccaaaaaaagggcccggaaatttttcccaaatctctttgaacatatggcgacccttccaatagtctcttgggccctcggcatagctgggattacaggcatgaccgctcccagccctaaagtggcaaatttgacagctaaatcaattgtaaaaattctgtaacaggtttattgggagattttgaagatcatgaagaaataaataaggttcataactagagatttgtggtattttgggatgcctatattgtcatcctgatcctctgatcattactactactaaaacttaatctagtacaaataattctgtattaaagttatgtgaattatgcgaagtaaactctggatttaaactgttacaaatggctaaatgcctacttgttaactaagtaatttgatttaaactctaatctctgtctcttttttaataggtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcggggtacgtggtgcgaggggtggccgcggtggaaatgtaggaggaaagcgcaaagctgatgggtacaaccagccagattccaagcggcgccagaccaataatcagaactggggctcccaacccattgctcagcaaccgctccaaggtggtgatcattctggtaactatggttacaaatctgaaaaccaggagttttatcaggatacttttgggcaacagtggaagtagaaacagtagggcctctgtaaaattggagactgataggttgatcagaaactcaccctaaatctgaacgggtgccgctataatttgtgacatctggcaagatttccctttatgtatatattttaacaatccgcttggacacgaacaaagccacacttctaactgcttctggcgaactgattttatttttaatttttttcaataaagatattcttagatactgaaagaaatagttaatgagtttgcatttgtgcttgagaaaatttggctcaagtccatttggctgtagtgtcaacgatgtttccagtagtgtttagatttggtgtcttcaaaggtagttgattaaaaccaagtgtgtctttaatatcttgtatcagaataactttgtatgttaccaacttaaattgctagaataaggtaaattgatacacaactgctatttttaatttagaactttgacctaatttgggttttcaaaaccattttggctacttgtattctttatgctgttgtttatttcaataaaaaattcacacctaaatgtatacttactaaaattgtgtttacaattcgtttttcacaaaatttcctgcaaatttggttcaaattgtatagcatgtcaaggccaattaaagggttttgtgccttgttaattcttgtgtggaatatgtctgcacattacacaacactgatttattgcagttttctgcttctggtttaaagtgctattttacaacagacttcatgttcccatcaaaaataaaaagataatacatgtagtaagtttaagttggtaagtattttagagttcttaattgtgatgaatgaactgtataaaaggacaaattcaggtagtctcaaagggtttgcaggtcacactgacaagtccactttcagttgcctaaagtttatcctaactaacctaaaactcagattgagtatattgccctcttgactgttttgcacaccatgggactagaaagcagcaaagaaactctagtgtgaaaacaatgggaataggtttgggtaatttgtgagttgcactctaaataatcactgtacttacctaattaaaaataaaacagctttacagttagttttgggtaagcaaatatatatctgaaggataaaatttacctcacagactggtttgtattaaagatctaatagtttggatttttgtttcacattttagtcttgttttggccatatggtctatacttctaacagtaatgatgggaaaatgttagagttttgggggacagactctaggtcaacagtgaaaaggtttaacagccactccccacttctgaacctccatcacccttgaatttaaaggtattatacctgacaataaagttacatgtgaaaaatacatgacttgaaagacaaactttcttaaaaatgtcactaaatttcaaatctcaaggtcaaacaagtctgagatgtttgctttcagcatattttatgattacttcatgtctcaaaaatgggaattacttgcaagttaatgggtaactttaaggtgtgacttcatttaggtttcctgttagtctttttttttttttaaataaaatcagtttgtgaacaaaatggggttttcaaacctcagtccagcctcctcactcaaaggggcaaaaaagcaaccaaaaacctcaaagcaagtaaaaaacaagcaaaaagaagttcatagttattaaaggcaacttttttggctagacagtatatttagaattaccatgttaaggcttgtctttttaatgttatcattatgtatgtacacattattaatttaagatgatttatctaactgattccttttgttacctggctagcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatctgctctaagtagatttttccccttttttaaattaaggatcccaacagtggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaagcctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgtaagctggaggcgagtgtaacttatttttgtaataaagtttttattttttttatgtgtcattaatataaatgtgtgttagtgtagaaatcttctggtttaaaaacttagaattgcacacatttcagtatgtttatttgtacttacataattttagaatagtggttgccaatagcctgtatgtttcacattaattggttttttgttatctaaataaatcattttagtatgttgtatgtcagttactgggatagctgggacatagagtgtaatttaaaatttgtcaataagtattcattggaatatatgtaaatgtgccttgccggttattgaaacttatctacaaaatgagtatggggtgacaaaaattagttcctggtgcttaatgaaactttctgccactgattttatatattaccccgtgcttttttaaagtacatctctctcaaaacttagtgtaagtttgagggctacacaaaacatttacatttcattctaacataatgaatataataggttgtggaaagtgggtaaactaaatgtagccttcagtaaaattgaatctcagtgtaatccttggtgctggcatttctcagttccgaggagttaaatgatcccatctaagaggtcattgccatgcctattggcactttactgtcatagcatttttaagggacactgtcaaggtgtttaagttctcagaattacttgttgggattttaggacaggtttgtttacttaaagtaagaactgcattgtcaaagttgaaagaggaacacttttgtgagttcacaaatgtgttcttaagaaaacattaaaatatggagctctgggttttcaagactatttggcattcttaatttggggacttgggagggaaactgataaaaagaaattgaagaattgatggttatacttaaagaagggtaatgtaaacagtggtgatgaaatatatacacatcaagtgaaattacttgacagtgttcatttgaatgactttgaattcaagccattataattacttttaaaattaaatatcatttgcactgttctgataatgggtgcagtttttgagcaatataatcagagctaaatatgcatgtagtgattagtgatgtgaacaattaacgttctgagaagaaatactaactgtggtattttcaaacttaaatttctgtagtaaaatcagtatcaaagtcttatcagatcaaggaaaaacaggcaatgcatataaacatacttttgaatgttgtgtggcctataaagcaataatgcaatttatatggaatgtcatgggatatgagaaatggaaatgcaaaaataactaatcctttagtaaaaatgtcaacatgttaaagggggaatgttaactaatgtaggttattgctatttgtgatttgtttatgggttcttggctttgacagcttcaaagaatggacagtgataagttaaaagaaattttgtatattgtcaaggaaagggtcttaaatccgagtcaagtcccttccttggggtaaaaaatgtattcttaaagcattctgatgttaaaaagaaaacttaagttatctaaccaaaacagacgcaagattttgtttctgcagactacttggcaatcaaaagtgatcataaatttaggttatcagttttcagaaagttgctttgtgagaaaattttgttagatatattctcccaagcatgctttttgtggaaggttttcagccattgccactgaatcagatgttaaaaatgaagggaaaattgagtgtgcacacacacaactgttgtacactcatgattgcagtttttagcttaagaaacttttctaccagttactgtgaatctgacttaaaatgtaaagtttcctcatgataaaataggaacaacatagaaatggattgatggggtgatctgagttattgtatataaaagtttttaaagaatagaatgaacatcaagctagataggcaaaaattgacacattcagaacagcttttttgactgcgaagccaaaagttgtcagaaacagcaaaagatcccttattattacagagtattttacgtagtctctattttaaggagagaaattaaatagaagggcttcatgcatttaggggagggtgctaaaacttctcaagttcgtcaaacttacaggaatacccaccatgatcattttctctctaattatgtataccacaaaattttcatctggccataggaattcactggtgggtgtaaaattaatgactaaagaaattaagtgacaaatacataaaagaaacagacttgtggggatattgttttaaggtgtattaattactcagtgatgataccactcaatagggcatgccactacttttcttaagatgctaattatgaagcagtgctcacaggcattttttaactagcaaattagtagatggacttttggggtctgtcactttttaaaagtatttaagacttaaattctattagcaccacagtctgccttcagtaatacacctaaaatatttttcaggaccagaagcattcagtttgaaaatttgcagatgcaaaccagtattattactaacgctctgggtcaaagattaggtttttaatattaacagtagtctggtaaatatttagaagtctggcattgagaaacaaaagcttgtacctgactagtatttttatttaaaaaaattagttctgttagcttatttaaattgtgttttatttatccgtagaatttatatttatttcattcctttcatctcactgaaaactgtctgcaggccctttgatttggattagatgtgtgaagtactgtcttttgccaaaaacctcaaattacctgttcttttcaacgtagtgggtttgtgcttgtttggagatcagttcaaaaactatctgtactatctgtactgcctctgatgttaagattttatgtatagcataaggaagctagctctgactatattttcctaagaataaagacctatttttgtagcatgtcttaggatctccaggagtccaagaattattgtgggtgtcctccaattcatcactcttcacttaacagcttttaagtagacacttggaatctttagaggtctgtcgccctttgattatccatacattcgaagtaactagccaatggtgaaaaattcctcaagatatcctcagttgcaatcacattactggaagatgaatagaataaatgtattaggctggtcttaatttttgatggaaatattctgttgtcccgtacttgccattggatttgataaagttagtggtaatttggaaagaatcggggacttgccaatatatttgtgggttttagcttatacccctaggatttcttggttgcgggacgagcagttttggccacttccatcaggacaagactttttaggtcacttagtgcaggttttagtttctattttggattaacaacatttatattgattatcgaaaagaagctttcatcatttcagaacagtcctggaagtttgactttgagtgtgggagaagtcctaataaaccattttggaaatta

SEQ ID NO: 13081 - DNA, 803 bp, Homo sapiens
gcagaaattaagttcttaggagttcttcaacagtattaaagacaggttctgttcccttttggtttcctgcctaactacaggtacagttaaacatggaattaaaagacagcctttattgtaaaattgtcatgtaacagatcctagttgatctctggtttcctggagatttatttagcatttgggagaggatcaacaaaggggcacagcaagcagatactgtagttagtattatttttcccttttttgcttactgtctatcgattagtctttaaattactagtacattttatgataaatttctttgatttattttacctccttttagaatggaagctcctcgaagggcagggaaatctgagtaggcaggcatttaaaaatatttaaaatgttcagttgggtggaagtttagttttatttgccaaattaggcttgtgacatgagaatttgacaaaggggatcaaatatttcgaaccatttaatttatggcatggaaagcttttaaaaatgatcacaaagtgctaatgatttaagtaaattaagatgaagatccacatttaaattatcaacgtgacactttaaaaaattataaaattgtcttaagttgagggaacagttggcctagtgacttacagatttttttatatgttaaaataaccctatgtgtaagtgactgttttccttatttgaaattaagaggaaaagggtgctcataagtcatctttagcagtgaacttaacagaatccagtggatcagttttcctttatgctgatgtgtagtttaatttgtgctgctgaacaagaca

SEQ ID NO: 13082 - DNA, 2878 bp, Homo sapiens
tgtccagaaagctgtgtttgggctcagaattactcactacattcatgcaatacatatgcaagcagggagcagagagctttatcaccggggctacacaacagaagggaaaaacagttatgtggagagctggtgacctgacacgggaagcttgagggctgcggtggggaggtacagtctccccactggattgtgctatcagagaggcggctgacagccccagatccatcttgaaaaacccagaaacagccatgtggactggtctatggagtctgctcacttggatagcttgggagggggggggtgctgcgacttgctcaccccaaataggaggtataaaaccaccacttgttatcgagatcatgactgtgcctgggattaagaccagtggtgggcacctatgggagaaggtcagcgatgcctcccagctggggcagctcagggcctctccctgtagcacttcatgtgtaagtggcctgagaggccatccttggccctggagagtataattccccactgtgcagagcacacccccttccaaaaggaggccaagagccctggcctcactccttgctcagcgtgagcctgtttccactgaggacagagcccagccagggtagtgaacatgacagcttcttgccagacagtgttgagagggactcccaggctggcaggtaccctccattttgttaagggcaaaacaggacaaaaagggaggcatctggagaaagcaagacttttcttagctcgttcatcttcttccagccctaaacatcatagaagcccccaaaaggcacgaaaaaggagaaaaggctcctgctgcgttaagctagctcctacaagtcgcttcctctcttttgggaaacgaacaggaaatacgagaaagggcatggcagacctagaaagtggttggaggtggctgggggagccctgggcagagtccagcggtcaggcagtagtttcaggcagcacctgctcacagctgtctgtccatctccacctgacagggcagcgattgactgccattcactgcccattcctgcctgggcatgaggccaatgccaggagactgacagacctcatcttgggcctagttcaaggctgtgaatgagtatgactgatcctgttttgctgagtaaggaaatggttggagagctcgaaccacttgctcaaggtcccccacttgcagtttgcagagcaggaatctgagcctgagtctgccggaccctgggatcaggcacttcctacctcatgaggctgccttccattgagagatgcagcagggcagaccaaggagggaaccctttgcccctagcttctgctgtccacagttacctaaagactaagttttgtgggtcaagggagtctatgacagaatgcgacaccaaagcgtggaatggagttgaggtgcgatgcggcggcgccttccgctggaagcacggccactcacctatcagcacctcccactttccgttggcctgggtcacctcgtaggcgcagcgcatctcattcaggctcacacccccaaggatgaaaatgatgaggcgggggccactgcggtactcgcctggggccttgttcttatgccagtgcccatagcgggcgctgagaaagagagagagaaagagaatgtcagtcagtttatctgcactcacggcatctagtgcttcataccccagtggtttgtttacttattaggtctgtacacttgtgccccaaacagtgtagatgcttagtgagtgctggctgaaatttcactgcaatgcaattttcaagtggattggttcccaggagaagagtcactatgaatgcctgtgctgctgtgaccttgtcactcttagaaacatgcaggcaacagacaggatcagttcagctctgacgtttgctgggtcaagttctgtagcatccccctgctagaggctcatgcagacgtctaccccaagtcacacatgcctctgagcttgcctgggacactctgctgtcagtgcacagtgatgacagtctaagatctgccttcaggctggcacatagatcccttgaaaacatgtactgagtgagtgcctcttggaggccagggcctccccagtaccacatcctaaggagacacaggccttgaccaagaggtcatcattgaatggggcaggtggggagaaggaagtgagcccaaatcctggtctgatgaagagctctgtgctatagggccaagcacagggaagccctggaaccctgtccgggcaccactggggaggcttctccatccctgagctgcctcctggaaattgcggcgaagccagggaggaagagtacttcagtggcaaggctgctcccagaggggcctccctctgaacctgggcttccttcaatagctctttacctttgactgagaaacaggaataaatgggttgttcccaggttaagaaaatgagaaaaatgagatgaaaggagcaagtcctttctggccactgcaatgcgtcgcctttcttcctgactcatgacagctttacagtcactttccaaaccaggaagacaccgtttggggcaccgtttgggccaacagagaatctcacagttgctttctttccttgtgcaatcatttgatatcccattctcatcacccagcctgactgtggcgctacttgggattttgtattttatgccatatttggcaaaaaacgttttacctctgctgccatgagaagggctgcacaatgacacagaggccaccacaggcctctggcccagctgaagccaaaagtgaacacagagagaagagacgcaaaagagaagacaggtggggaaagcaggagaggagggacagagatgtgcacatcctggggtgccaggtgtggcacagctgcagtgccagggtcgccctctcgag

SEQ ID NO: 13083 - DNA, 9044 bp, Homo sapiens
gctagacaggaaacacttttgaaagtgctgttttgatagaggatcaggagatcaggcaaagagctgtgaactttatgtgtagcctaggccatgtagcactaggctagccacctgagggtatggagtaagaaaggaaattaaaggagaagggccagagatcttacaggcaattttcttttctcaaaagagcagtgctaaaaattatgaatttctttgaagtagaggaacataattaatgaatttctttgttgttgttgttgtttgtttgtaaaacattctgccatcattattcacctttacatttttaacatgattgttagcttagactacgagagctaacctcacccattctaaccacctttttatagctctcagaagagctgtcttctaaggaaaacactgcactgagcaaaggttgtacttttgtaagatggacgttttataatgataagttttgacaacttgctctggttgccatgtgtctcccagtcctgctggtgggtgggtatttgtcaggaatgagaatacgtctgagatggtctgctttacagcagccagtcttgattttcaacttccagggccttcggcatccttttggctctgtaaacatagaaggctttgctgcccttggctgtgctgttggagaaaaggagagcatcctgtttagggaggtgccgatcttcagtttcagaaccattgtttgacacctttagttcctcccgtggacttcatgtccttccttgtccatagtttggaacttacaatctgagtattccttctattgagctactcttcaaggtctacagaagccatttttgtttataaagctgtaatttctcacagcagatcatttcattatttctgtcttaattacagaatttcaaagaaaaataaaatccttatctgtacttaacaaagactgccaacacttttccatagaccaccaatgattcttgttttgtagctttttgtttataaaggcaatgttgtattccacagcatcattacacactgcttctgtgactcagacagctggcaggtccaagatagagcatatggatgatgctctaatgacatctgtccagttgttgtaatcacatatttggtggacagctaaaagacccactttcaccttaactgagtttatgtgactaattttaaatttactgtaaacacttttttatacgtctcatgcttattaatacttaataataattccacaagtatttctctcaattctaaatcccagagcaccatagaaactggcaaaatatcttcccaattaattatgagaaattcatctgtacaattttcttattaattctcgtatccaaaagaaccacaatacaacccaagaccccaatcattagaataaccacaaaaccgattcttaattacctcttgcctgggacactgcagaagtaaccaaatcggtcccacaaacataagcctctctaaccctgccacctcccccagtttatgttacgtaatatggtgagaatcttcttcctcaaatactttttatcctgtcatccctgttctcaagaatcttcagttgtatcccattttacaccaggaagttcaaatgtttgaatggagatttaaaaagtctagctatgcttcttgtacatcccctctaggagcacacccactctaatcaaactgacctttttagtttagctgggctccaaccagttctgttctagctcctgaagtcagcgtcaagaaatattggtcttggccaggagcggtgcctcacacctgtaatcccagcactttgggaggccaaggcgggctgatcacttgaggtcgggagttcgagacaagcctggccaacatgcaaaaccccgtctctgctaaagatataaaaattagcctggcctggtggcgggcacccgtaattccagctacttgggaggctgaggtgggagaatcacttgaacctgggaggcggaggttgcagtgagccgagattgcgccactgcactccagtctggcagacaaagcaagactctgtctcaaaaagggggaaaaaaaaagatgttggagacctaggttctagagtaaactctgccactacctagctaggttgacctttaacaagtctatttaactttttcttaggttatttctaagagagtttcaaaatgaaaaaaaatactatgtgtttgtaattttatgattataattccatttaagtaaaataacaaaaataacactcgtatcatagacattagagagttcttacttggaaagtttcatttcctaatgacatcactgaaacagcaggtatgacagagggttccctgactttgatagttttaattatcttaatttatcctctgttcctctgccttgggcttattaagttttgaattaggtatgaaaattattaagccaggggtataaattacaattcgttaaataaattcataatatattttatacgcttaaaatgaaattatattccaaactcataattaagtatgaacaatttgcatttgagattttaaaataaagcctaaacatcggtcccttccttcttcattaatttatttctccataaaggcctttcttccttgaggtctgtgagcctccaggcctttgcagcctgtagtggtctgcacttctctgtttttctttccctgagagtgctgattagtgacttgcggtgtggattctgatttatcgcagaccagagctgccccttaggggctgagcagaaacactcatgaaggagccctgattaaaaagagtggtaatgaagacaaatgtttcagagggagttgagagaaaaccagtccttggcattccccatagctcctctgagcttttgaaaaggaggtagtggtagccaaaggaaatatttcttctttgttgtttatttctcatggcactggaaacatttttcttttcctcttgggtgttctaattctcacttgttaactgcttttcatgcagggttgcaattaacccctggcagatacctcaccgtgttctccttatagccactctgtccccaaagaagtttttaatgctttgacctataaccattttaaaattcttcagacttgacacttgcctaatttctcagatcattaaatcacacttctggttttttccagtgatttttactaaatttgatgttaggtacctataattaccttcccttcttcttatttttacaagacagaatgccagcagaaaaaaacaaattcctgttcacttggtaattttaaacacaaccaggtcaaaagtttcaaatctagtgttaagtccgtaactgaaggcaccattccaaaactacttgagtataggtgagaacttgacagataattatggttgcttgacctgggtcttggggcatctaccaaatcttaatggtagtctcactgtctgtggccatgtgagctataatctactgccctggtcaaacttaaccaaaattctgttttctttcagaagattccctaacattggaataaatggtaagaatatagattgtttgtgccgggcttatacaatgggtctctaaactatattgagtggtcaaaatgccacattcagaatacttagagagggagaaagataaagtgccttggaagccgtgaaacattctagggagcaagagcacaccactgtacatgctcctggtttgtgtgctgcagactgtgttaaatgcagaggaggcaaggtggagagaaggaaagacaagagaagtggaagatagagtccactcccctatccccgtcaatgagaagaagctccttaccaggtctgtgtgggtcacggggcaagatcaaagaatccaagcaaggttcataaaatgccaccacccctgattcatgacctgacctactgaaaggtttaacttccagaggcaggttgtggtttctgatccaatcaagtggattccttttcttggagaaagtctcactgtactgaaagaatcttgtcagatatccaaggctaaaggaaaattttaaatctaatccaatcagatgaagaagctgataaaaaaggtataaccattagtgggagagcagcatttaaaattctctctatggcttttctgggctttttacctctgtctcaaccaaaaccaaaacaaaaccccagaacaacaacaaatgagttgaatgttgctcagatttggagtatttgatgttacccctttctgatgaacgtctgagattaaagatctgcattaaagatgaaatagaacacactaagaaaagggttgggtaagaactttcacacatactttgtttctattgaggttgggtccatcttgaagatcagactcttccccaaatacaaaggcaaggtcagggtctgagttaggctaactgatgtcaagtacaagttctgtaggaaaaaacaaaaattgctgccactcatctaccaagagacaaagatttaggctgctggactaattgccaagtttgtaagattacttcaggagcaccctccaggctagtagaattccgtgcaaatttcaaccatttgacattacttccctgttaagtagggaagaaagacttagtaattttcaggactgaaccaaattccccctcaagtattgatacactctcttcccagtctgaaatactggcatactgttatttatttttcctggcttcaaacaggcatattaagatttcatggatctctgaatctttctttgaggatctgggaacacatcagaaaaaccagatagaaaagagggaagaggaaataggttatttccttagcctcctgaagcaaatgaattggaagggtgctttctgtgactttcattggcctgcaactgcctggaatctcaaaaaaaaaaaaaaaaaaaaaaaggaaacccaaaaaaccatctttgattccttactgtgtaatcttttaacaaagtattttgcaaacatacttagcatgtgattttcacatatgtgttccaaggagcaatggagcagagttggagagatgaaagcatttgaagactgcaaagtaattttaaattgagggatgtactaacaaaggagtcatatacaaaaagggaggagaggtagagttggcctgatgtggaaaataaatatttcatatagtctgctatagtctggccagtatgaattaaataaaagtcacattcataatgaacactggagcaattatacatcctaaaaagaaagggaagaaataccatttcgtaataagaagatgaggatcaataatagtagtgaacacttgttgattttttaaaaatcaactgttaggcactgtgctcagactttatgagcattgtctcatttttcatcgttttataaattaggaaattgaggtcttgtgaaagtaacgtgcctggattgacacagtaagctggtggaatgaggattcggaaccacgcatgtctgactccagagccctcgctttttacaccagcctctactatctccctgtgtgactctggtcagttaatccatttataaaatgagagtattggactgagcaatttctagatccttttggttctagaattataggaaagtattttaaagtcgagagaactgtgttatggtgggacatttagagacaaactgaaatggtgattgtaatgacatttcaagttaatgatagctagcattgatggagcctgtactatataattatgtaattatatttacaaacacctcatttaaccttcaaaacaatcctttttgacatcagttttttgttcctaagaaaagttaagtaacatctccaaatcacagaactagaattattcatgaagagtcagccacatcaaagatccaaaacacgggttttaagatttcaaatggttaatactctacttttctcttagattgttgttttgtttttttttgaaataaaacatttgtacaagtcagtaaaagtgatatacagtatttcttcaaaactggaatgttattagagttcttgcttgaaaatagttccaaattaaacatatgaggtttccagtagtttgaagactttagaatccgacttgagatcaaatcggaactgagacagtgaggtcacctaaactgcgacgtgtgaagtgccctgtttcatgcttcttataatgacatgataaggccattagtattatctttattataacagatgattataaatggtacagacttggtttcttattatctggtactttttgtcacttagccctaattttcttaattcaaagacatattctgttagtactagggagcaagtttaagactgactttgccacactaatcaaattacatcagtgtcaagtgctcactaattaacacaaaatttatatctgcattaggtaaatgtcatttcaccacagtggcctgaaataagctttttattcctttgaattagcataccatttcattgtaagtattacaaacaagctaatgacaaaatttaggcccatgtgcatttgttatttagctggaaatagccagaagacagtcagtacttccaaagatctgtaggaaaatgccctgcttcattttttaactgatcagctagctgacttgtcaccttgaggtcctgtgtgtacatcatagaagggcttagcagactactgccaccccctgtctatatgcagcccacgggctagaacagttctcacatttttaaatgggaggaaaaacatcaaaagaagattttatgaaacctgaaaatcacatgaaattcacatgtcaggctcataaataagttttaatgcaacagagtcatgtctgttcacttatgtattatctatggctgctctccctatgatggcagagttgagcagctgtaacagagaccgtgcggcctaaagatacttactgtcgggctggttacagaaaatgttttccaaacagaagctgtattccaaattctttcctaatgtggcatacaaagcctttaggatctggctcctgtgtgcctctcctgccgctgctgctgctgctgctgctcctgtttccgcttctgccatggccaccgccactgccgccgcctcctccttcttccctgcaccccttcgcgcctgccttccccgcgaccggcagcctgagctctaacaattctcaactactagcacctcttagactccaaaatgctttgcacctatttaaatgttttcccgtgctcttccctctacataaaatcatttctttccatcctgagtacccatggcaagctcctatcttccaatatttttacttaagcatcccctcttcttctctgcacctggagcatcttggacatagctttgtttccaccttgcattcacccactagacagtaagctttttcaagacagatactgtctcttcttcatctctatatctgtagaacagggtttctcagcgtaagtactgaaggtattttggactggacaattctttgtgtgcagctgttttatgcatcatataggatgtttagcagaacccctggcctctacccgttagatagcagcacgcccccttccctcagatgcctccaaatattgccaaatgtccccttgtggacaaaattgtcccatttatttattgagagacggaggctggatgttgtcgcccaggctggagtgcagtagcgcgatctcagctcactgcaacctctgcctcccaggttcaagcaattcttatacctcagcctcctgagtagctgggattacaggtgtgtgccaccacacgcagctaattttgcatttttagtagagatggggttttgccatgttgcccaggctggtctcaaattcctggcctcaagtgatccacccacctcggcctcccaaagtcctgagattacaggtgtgagccactgtgctcagccaattgtccccatttaagaaccactaccctggaaaccagcagtaaccagaccctggtgggtgctgagaaaatgttgaattattcagatagttgattcacattgaattgtatacatcaaatgtaagaattatgaattacatttcaataaaacttttttaaaaaaagtattggtttactattagttattattagtggcattattatgaggtggtttccatttgttttcctcagtggccaccagtgcaactgattttgtcatatactgtactcattgatgccaaatatatatatcttatttaatgctgacttcaaacctgggaagttgatttgtttatctcttcttaactttttggaaatgcagacacaaaaagattcagcaaattgcttaaaatcgaggtaactagcaagcatatatcaagggatacatgactcggcttctgtctagtttcaaagcctgtactcattccatctgaccatgttgcttccataagccacatgccagccacataatgaatttcttgattagaatacaatgcatatacctaccaaagatagtatgtgcatatagcaaatatgagcaatttctaaataatgggagcattatttttgttcaaaatgctaaaaactggggccaggcgtggtggcacacgcctgtaatcccagcactttgggaggccaaggtgggcggatcacctgaggtcaggagtttgagaccagcctggccaacatgatgaaaccctgtctctactaaaaattcaaaagttagctgggcgtggtggcacacgcctgtaatcttagctactctggaggctgaggcaggaaaatcacttgaacccggaaggcagagattgcagagccaagattgcaccagtgcattccagcctgggtgacagagcaagactccatctcaaaaagaaaaacaaaacaaaatgctaaaaactgaattatcagtagaacagcccatgtactctgtggacggtgatgggtttttgttttgtgggagttgttgttttggttgattcggtgtttcctttgagtccactgaggagccactgttttcttccatatctttagatcctgatatggtaggacatgcacaatctattttgaatcatcataaagattgaattttcagcctacaaaaacaaaagaaaattcttagggcatcagttctcatctttcagatagaacctaggacctgtgaggctggtaatctttggaa

SEQ ID NO: 13084 - DNA, 2194 bp, Homo sapiens
tcaagctggacctttgtcatttgaaggatctcctcctaatgccatctaagcttgagaggttcatatggctgcagcatggtttatcttgctgtttaaacattgtgtccattcaagctccattgtagacctttcttttaaagagagttcaccctgggatattaaataaaatggaatttggatggaaagttggcatcccagttcggaaccaatttttattgggcacagacttggggggagcagaaaaaaacaaacacaaagtctatgttgtaaatgataataaaaaaagaataagtaaaacaaatgaaaatgtttcgttttactaaggcttttttgcattcccatgacttcaaaatacttttgcattttatggcaatctataactgctttagtatagacagacaaagaacaaataaagttacataaatgcagagaataacagaagaaatatgtagaatgacagtggtcagttggtaaagattctattggaggttttggaggtttttgcataatttgtattagtccaaaaatattatgaaattaataataaattttaaagtgtatacgtttcttaatgtcttcaacttgccaattctgttgttagtcataaacttttatattcctccctatgtttatctttcccatctctccggcttgcttttgttattactgttgctgattctcaaaaccattagatcttaagtatattccactaccaaagtcattaattttaaggagaaaatgggaagttagaagccatgattttacttataataatccatttgtctcatactttcatctcaaaaatatgtatttaagtagaaagagagccagaaaaataaccgagagagttatattgtaattctggctctactgtatactagtagtgtgattttaagttggtaatttatcctctgtagcctcagcattgtcttctgaaaagtacgttcactcattcgggtggcgtgagatttaaaagaaatgactcctggtagagtagaatgaagtagaatgtagaatgcggtagcaatagaatgaagacatgagtattgatgatgtagcactggactgtgctatatgatagttaccagccacatgtggcttctttaaatttgagctaattagaattaaattaagttaaaaatttagctccttagtcatacgagccacatttcaaatgctcaagaaccatttatggctagtggctacaatattggacagtgcagaagaactattccattattgcagataatcctgttgaatagcacagacctagaatgacagctccgtgtagggcactgggaattgctgtttggggatggtatcaccttgagttggtctgtgacctgctgggagtaatgcagttctcaaagaactctaactctcctttaaccgcgtgcaaaattgtgaacctgggatgcgtgagggagtggttattttgtgctgaatggtatgtcagctacatcaccacagatgtgagatcagcagacttgcttattctgagtgccgtcagaatcgttaagtaccatatgtccagtgtcatctttggcacatttatctggcttcatctgagttccgaagtgaaatctcacagccgccttcataaatttagccatcaaagaccaaggtgatgatgacataccaagctttagaatcctcaagtagggtgggatattggtgctgggaatgacgaatgaagggacatctgagaatcatgctgcttttatggattagcagaaattcatcttacgtgaccaagagcagctgcataatggctagaaaacatttgccctttctgcttatgttttggttatcccaacacattctatgtgcaatgtctgagtttgaaagttctttttaaactataaaatcatttcccaaagttaggactgattatgaatatcatcaatgattgtttttaaatgtcattatggtaaagtcatagaatagtgaccatctgtgctgcctttgtctttgtataggtgcagtagtcccagcctttctttctctctctctctctctctctctgtgtgtgtgtgtgtgtgtgtgtgtgtgtgtgtgtgtgtgtgtgtgtaggatcactgcagtatggtggtgaagaaagctgtcacagcacagaagttcagaaggaggtactgtgaaggtcccaaagcattgagcttagctagttctgaaagcactaaggttaactagtcaa

SEQ ID NO: 13085 - DNA, 2194 bp, Homo sapiens
tcaagctggacctttgtcatttgaaggatctcctcctaatgccatctaagcttgagaggttcatatggctgcagcatggtttatcttgctgtttaaacattgtgtccattcaagctccattgtagacctttcttttaaagagagttcaccctgggatattaaataaaatggaatttggatggaaagttggcatcccagttcggaaccaatttttattgggcacagacttggggggagcagaaaaaaacaaacacaaagtctatgttgtaaatgataataaaaaaagaataagtaaaacaaatgaaaatgtttcgttttactaaggcttttttgcattcccatgacttcaaaatacttttgcattttatggcaatctataactgctttagtatagacagacaaagaacaaataaagttacataaatgcagagaataacagaagaaatatgtagaatgacagtggtcagttggtaaagattctattggaggttttggaggtttttgcataatttgtattagtccaaaaatattatgaaattaataataaattttaaagtgtatacgtttcttaatgtcttcaacttgccaattctgttgttagtcataaacttttatattcctccctatgtttatctttcccatctctccggcttgcttttgttattactgttgctgattctcaaaaccattagatcttaagtatattccactaccaaagtcattaattttaaggagaaaatgggaagttagaagccatgattttacttataataatccatttgtctcatactttcatctcaaaaatatgtatttaagtagaaagagagccagaaaaataaccgagagagttatattgtaattctggctctactgtatactagtagtgtgattttaagttggtaatttatcctctgtagcctcagcattgtcttctgaaaagtacgttcactcattcgggtggcgtgagatttaaaagaaatgactcctggtagagtagaatgaagtagaatgtagaatgcggtagcaatagaatgaagacatgagtattgatgatgtagcactggactgtgctatatgatagttaccagccacatgtggcttctttaaatttgagctaattagaattaaattaagttaaaaatttagctccttagtcatacgagccacatttcaaatgctcaagaaccatttatggctagtggctacaatattggacagtgcagaagaactattccattattgcagataatcctgttgaatagcacagacctagaatgacagctccgtgtagggcactgggaattgctgtttggggatggtatcaccttgagttggtctgtgacctgctgggagtaatgcagttctcaaagaactctaactctcctttaaccgcgtgcaaaattgtgaacctgggatgcgtgagggagtggttattttgtgctgaatggtatgtcagctacatcaccacagatgtgagatcagcagacttgcttattctgagtgccgtcagaatcgttaagtaccatatgtccagtgtcatctttggcacatttatctggcttcatctgagttccgaagtgaaatctcacagccgccttcataaatttagccatcaaagaccaaggtgatgatgacataccaagctttagaatcctcaagtagggtgggatattggtgctgggaatgacgaatgaagggacatctgagaatcatgctgcttttatggattagcagaaattcatcttacgtgaccaagagcagctgcataatggctagaaaacatttgccctttctgcttatgttttggttatcccaacacattctatgtgcaatgtctgagtttgaaagttctttttaaactataaaatcatttcccaaagttaggactgattatgaatatcatcaatgattgtttttaaatgtcattatggtaaagtcatagaatagtgaccatctgtgctgcctttgtctttgtataggtgcagtagtcccagcctttctttctctctctctctctctctctctgtgtgtgtgtgtgtgtgtgtgtgtgtgtgtgtgtgtgtgtgtgtgtaggatcactggagtatggtggtgaagaaagctgtcacagcacagaagttcagaaggaggtactgtgaaggtcccaaagcattgagcttagctagttctgaaagcactaaggttaactagtcaa

SEQ ID NO: 13086 - DNA, 2194 bp, Homo sapiens; identical to SEQ ID NO: 13085

SEQ ID NO: 13087 - DNA, 312 bp, Homo sapiens
ttatcctcgtgtcgattcttgccccattagctttcagcagtaaatagttgagggtctcatctggaaagttctattattagtaccacatggtcagtacattttaagatagacattttaataggcagaaaactgtatacaaggagagatgtgcaatgcagaataactatcaaatgatatctagatatcttagattgctactctaggccatccatggtcttaccccatgggttcctctaactcccttcatcctcccttaacattagctgtaggttttctcatcactgtctttgctcacgttattttctctgcctt

SEQ ID NO: 13088 - DNA, 312 bp, Homo sapiens; identical to SEQ ID NO: 13087

SEQ ID NO: 13089 - DNA, 312 bp, Homo sapiens; identical to SEQ ID NO: 13087

SEQ ID NO: 13090 - DNA, 2333 bp, Homo sapiens
ggctcaagtaatcctcctgcctcagcctcccgagtagcttggattacagggatgcatcaccatgcccatctctcctgctatgacttcttgatgctacttttcctgcttctccacccactgcttcccccaccacccactgccagtcttcctccatctccccttatctgcctgttcttacacactgttccctggaatctctccttggcctcttctcactccacacattctctcagggccttgccttttacttcagccatcgtctatactttcactctagaccactcctctgagatttcccaacttttacatccagatggctgctcagcacctccacctggatgtcccacaggcaccctaaatccgtccagcccaaaactaaactcatgatcattccaaacctgctctaatgactcttccatccacacagttgctaaagccagaaatcagttcttcccttttctcacctggtacatcaatcaaccagggattaagtaagtcctcattaactctatttgtctgttcctttccatcaccattatcaccattctgacttaggcctgagctgtcctgagttattgctcccctgcattattttgattaccttctcatagaggtctgaccctctgatctgtactctccaccagggtttctcaaattggcactactgacattttggaccagataatgctttattatgggagctgctaagtgccttgcaggatggttagcagcattctcagcctctacccactagatgccaatagtctcccacccattgtgacaatcagaaatttctctagatattgctaatatcccttctggggggcaaagtcacccctggttatgaaccactgctctacattgactaccatttgcataaacaaatctgataatattgctatagaaaaaagctcaaaccctctgacttggctgagcctccctgcagtctcatctcccaccttcccatctccagtcttaactccagagatcctgagcccctagtaggcccttgaacaaactgggccctcccacacctctgtgcacctcacctctgcttggaagccttcccccatctgatactctcataaattgctcattctttaagtctcaactcagggatcccttccttcaggaaagcactcatactgcctatctgtacctcatatatatccccaaatggaaatgttcttattggaatgaaactatttctttgcacatgaatctcccctctataaactccttaagatgaggggagtgacgcattcatgactgtattccgtgtctctaatacagtgactagcacatggtagacattcaatacatgtatattgaataaatcaaacattaagacttcttgtgacagttgtaaaccccaaatggtcatttttaccccgattctctatggttactaatagtaaaaactccaggaaaccacctggagagttgccctcttgcttcaggcactagtgaggagagaagtctggaagccatagcccattggtcctggccaagaaggagagtaaacacgtggaagagtgggtggtggagctgcacagcagcaggcgagcaaatatgcagagtctggccagaggacaagaggtcagccaggcccagagctagcctggaagtctatgccctgaggagatgttcaagagtctggtggagtttggagacataaggacactaagcaccagcctcctaagaggactccctgcccactgtcctctctcctgctgccattctccacagtgcagccaaagcaatctttcttaaagacatatcagatttgcttagagtccttcacttgctccctatgattttcaagataaagttgaatttgtgacctggctcctgtctactgtcttttctcatctcccccgactctttctcattagtacagctgatgccagcctgaacaatacagtctcctgaacacgtcctggtatttggtcagcagctctttccttaggcctggagtctccatctgcacacctcatattatccatttggcgaactgtcattagttcttcaaggcccctcctctgggctttcacagcactcatacgccacctgctgcagcactacactgctgatgtgtctccctatctagactgtgaccaccctgggaacaggattgtctcttttctttgttctctgggcctagcacagtgctaggcttacagctgtgaaataaaatcttgaacatatgaatcacggaacgatctgtcacacacctgctgatccaatcacccttaaagccagatagctgacttaataaaacccaacctgatcattcacttcccagctcaaagaaattcagtgatctcctcgag

SEQ ID NO: 13091 - DNA, 2332 bp, Homo sapiens
ggctcaagtaatcctcctgcctcagcctcccgagtagcttggattacagggatgcatcaccatgcccatctctcctgctatgacttcttgatgctacttttcctgcttctccacccactgcttcccccaccacccactgccagtcttcctccatctccccttatctgcctgttcttacacactgttccctggaatctctccttggcctcttctcactccacacattctctcagggccttgccttttacttcagccatcgtctatactttcactctagaccactcctctgagatttcccaacttttacatccagatggctgctcagcacctccacctggatgtcccacaggcaccctaaatccgaccagcccaaaactaaactcatgatcattccaaacctgctctaatgactcttccatccacacagttgctaaagccagaaatcagttcttcccttttctcacctggtatatcaatcaaccagggattaagtaagtcctcattaactctatttgtctgttcctttccatcaccattatcaccattctgacttaggcctgagctgtcctgagttattgctcccctgcattattttgattaccttctcatagaggtctgaccctctgatctgtactctccaccagggtttctcaaattggcactactgacattttggaccagataatgctttattatgggagctgctaagtgccttgcaggatggttagcagcattctcagcctctacccactagatgccaatagtctcccacccattgtgacaatcagaaatttctctagatattgctaatatcccttctggggggcaaagtcacccctggttatgaaccactgctctacattgactaccatttgcataaacaaatctgataatattgctatagaaaaaagctcaaaccctctgacttggctgagcctccctgcagtctcatctcccaccttcccatctccagtcttaactccagagatcctgagcccctagtaggcccttgaacaaactgggccctcccacacctctgtgcacctcacctctgcttggaagccttcccccatctgatactctcataaattgctcattctttaagtctcaactcagggatcccttccttcaggaaagcactcatactgcctatctgtacctcatatatatccccaaatggaaatgttcttattggaatgaaactatttctttgcacatgaatctcccctctataaactccttaagatgaggggagtgacgcattcatgactgtattccgtgtctctaatacagtgactagcacatggtagacattcaatacatgtatattgaataaatcaaacattaagacttcttgtgacagttgtaaaccccaaatggtcatttttaccccgattctctatggttactaatagtaaaaactccaggaaaccacctggagagttgccctcttgcttcaggcactagtgaggagagaagtctggaagccatagcccattggtcctggacaagaaggagagtaaacacgtggaagagtgggtggtggagctgcacagcagcaggcgagcaaatatgcagagtctggccagaggacaagaggtcagccaggcccagagctagcctggaagtctatgccctgaggagatgttcaagagtctggtggagtttggagacataaggacactaagcaccagcctcctaagaggactccctgcccactgtcctctctcctgctgccattctccacagtgcagccaaagcaatctttcttaaagacatatcagatttgcttagagtccttcacttgctccctatgattttcaagataaagttgaatttgtgacctggctcctgtctactgtcttttctcatctcccccgactctttctcattagtacagctgatgccagcctgaacaatacagtctcctgaacacgtcctggtatttgttcagcagctctttccttaggcctggagtctccatctgcacacctcatattatccatttggcaaagtttcattagttcttcaaggcccctcctctgggcttccacagcactcatacgccacctgctgcagcactagttgctgatgtgtctccctatctagactgtgaccaccctgggaacaggattgtctcttttctttgttctctgggcctagcacagtgctaggcttacagtagttaaataaaatcttgaacatatgaatcaaggaacgatctgtcacacacctgctgatccaatcacccttaaagccagatagctaacttaataaaacccaacctgatcattcacttcccagctcaaagaaattcagtgatctcctcgag

SEQ ID NO: 13092 - DNA, 3321 bp, Homo sapiens
gtccctggagctgggccatgttttgattgacagtgtggagctagcccagcaagtactctacatgcaaccccccacccaggcactacctctgctcctcctccatggcctcctgctacaccggcagctctatggaacaaggctgcaggcacacagggggcgctggtgagggacccccacccattcctgctcagtcaatcactcaacaaacattgagtatcttccatatgctgggatgagtaaaactaattcatctttggaagctccaaagagcaagggcaaggggaagtcaaggaaggcttctccaaagactttgagattttactttgaattgagtcttaaaagcagaggcaaatcaggtagagatgggcctttctgagcagagggacctaaactcagtagaagggaggagacttgagtgtggttgacgtggacatgctgggtgttgaggagggagaagtaaggttcattataaagggcctttaagactagggcaaggtaggccaggtacagtggctcatgcctgtaatctcagcactttgggaggcgaggcggatggatcacgaggtcaggagatcgtgaccatcctggctaacacagtgaaaccccatctgtactaaaaatacaaaaacttagccaggcatggtggcaggtgcctgtagtcccagctacttgggaggctgaggcaggagaatggcgtgaacctgggaggtggagcttgcagtgagccgagattgcaccactgcactccagcctgggtgacagtgcgagactctgtctcaaaaaaaaaagactagggcaaggtgcctgattttatcctgaagacagtgggaagccactgaagggttttaagtagaagaagaaacaatatcctttttgtgtgttggaaggatcactctggatgcaacatggagaatggatcagaggaggcaggactgggggcaagcagagcagctttaggagactctggaagtctccagggaagagattgtggtatgggtagtagggtagtagccatggaagggatagagaataaatatggggtgaagaggaaggaggtgtcgaggatgactctcagatttttgctttagataattgggtggctggcggtacctctcactgaaataggaggtggaacaggttttgtggggggaaatgatgatttcagttgaaagcaagttgtatttgaggtgccaagtggcaatgaacccgaagctcaggagagaggtttgaactgaagacaagacttgacagtcctcagcatatagatgatatgtgaaaccctgctttccgctccccttctctaggagtcaagtgactctaacccaggttcttcagacccaagaccagctgtgggcaagtcttagcaatccccgtgctgccatgcaagagctggctggtgagacccttcctctcccccttggagtcatcagcccccaggagagcctggaagagggtgggggtgggatacaattcacagctttggttttggcggtggtggaaactgaaggtactggaactgagagactctaacctcatcttcagcttcagttttctacgggggtcctctgggggacactgaggacagggaggccctgattagcctcacacaagcctgcctgagccccagtagtgggagctgggtccagccacacacacctcagtctttgctggccacgctcatgcccctcccaggtaagcctcactcaggtatctgttttggggtagggaatagtgcaatgcaatgccaccccccacagaaatgtggacagcagtctcaataaaggtatatgagggggtaatattcatactgttatgggggtgatggcagtaaaggctcagaggaaggcctactctctcgagtctagggtggggagagtccatcttgtccctcacccctcacctctatccccaagagctaagggagctggatgcaatggcagagtgcaaggcccagatgcacctactgccctcaccacctgaaccccggctctgcggactgagtgagggcccccaagcctggctgttgcgacgccagagtcgcgctctcttgagtgcgctgcagcggagttcacccgtgtgggttcctgagtctcgaagaggcgcccagcttgcggaaaggcgactgcggcaacgcctagtgcaagtcaaccggaggctggagtcactgcaggatctgctgacccacgtgattcgccaagacgagtccgacgccccgtggtcagtgctggggccaaatgcacggcggcctctggagggcgtcttagagaccgaggctctagaactgagccagttggtgggcacgctacaacgcgaccttgattgcctgttgcagcagctgaagggcgcacccccgtgcccctcccgccgctgtgctgcggtggcccacgctctctggactggccgcctacccttgccttggcgacctcatgcgccggccggtccgcagccgccctggcactggctgcgacagttgtcgcgccgtgggcaactgttggttcgttacttgggcgtgggcgcggacgcgagcagtgatgtaccagagcgcgtcttccacctgtcagcctttcgccacccgcgccgcctgctgctggcattgcgtggggaagctgccctggaccagaatgtgcccagctcgaatttccctggtagccgaggctcggtctccagtcagctccagtataaacgtctggagatgaacagcaaccctctgcacttcagggtatcttcgcgccgcccctcgttcgcggttccagtcccctcgaagtctctaattacacctcgcagttaccccttcttggtgatcttgcccccggtaaccctgctagcttctccgatctcgcttcaccacgacctcctacccgctaacccccacttcccacctgccacctcccagcttcctagccttgcctgaccagcttctgacgcccccaggtggagaatggtccaaatcccacggttccagagagagggctgctgctgatcgggctacaggtcctacatgcggagtgggacccaatagctggagccttgcaggacagtccttccagccaacccagccctctgcctcccgtcagcatcagcacacaggccccgggcaccagtgacctgccagccccagccgacctgactgtgtactcgtgtcctgtgtacatgggagggccccttggcaccgctaagctgcagagcaggaacatcgtgatgcatctgcctttacccaccaagctcacccccaacacctgtgtccaaaggagggtccatgtgtgcagcccacccctgtcttgagcccgtctaccaaaataaagttgtagtgattccatgaaa

SEQ ID NO: 13093 - DNA, 459 bp, Homo sapiens
agagttcccctttctcagccagaaaatgtgcttagagagaaagctggccaaggacttctgattgtggcccagacccttgacagaaatgatctgtgccattgtttaccctcctgagagacaccaagaccctgccatggctgaaccctggaaacagcttctgctccaactctctactgtggctgtgggcccggatatcccaggagacagacttcccctacatcaatcctggcaggcagcagcacagctgcggcaccatctccagaagctgttaacgacctttgccctctgactcgctgcaggaagaaagcaataaacagtggtctggggaagttgtcaggaagtgaccccaaaaggcacaggggccactgactggaaatgagcaaggcagaagtgaatttcctggcctgtacaacccctgctcagaggtttcactgcaaatacagtctccattttcagcag

SEQ ID NO: 13094 - DNA, 2444 bp, Homo sapiens
cttttttaaatatctatatacttttaccataaacattttcatgctatgaaagttgttattaatttgtccatattcctacctaatttataaatcactggggctaaaggatatattattcatggtaggcaaacagttgcatcatcacacctaaattttagtaattattaaaagtccaacatgggtgttctttggtacaccttctggtacacattcactcttctggaatgttctcgtagtagcaatgactcaaggaccttagtgcttatctgcttgtctcttctaggatttgactttgtcagagtccttaacattaaactcgcagttggggaaagtacattacatatgctctccctccctttttctctccgcctttcccctgctctccccttctcacctttccttcttttaatgaacaagccctgacaatgatgtgcaatatttcaatctacattttgctggctaggacttagtcatatgctacacacatcactcttgcatacaaccctttcagacaaaaggtctggattaaagtaggcagcaatttttttaaatgtaaagttgtgatgactaaatgagacagcaataacaaccaaataaactaaaatcccagcacctgagcaggggtagagggctggatattaatgatctttttatttctgacctgctcctgaaaactcgctactccttctaaaaaagaactccctaggctgcctttccaagctgctgtgagtacatttaactcaggctaaatattgaattcatcgtcacacctgaccgctaactaagatagcagacaatggtttcagctcctgcactttcctggcaaaacacctccagatgttgtccacagtagtgagacatattaactgatgtcatggacacaaaactatttaaatcgaactacctcagaaaacaaagactgaactgaattgttcaatctggataggggaccccagggcaggaggccacatgctggaagtccacaatcagggcttcagttaccccaattacctgattagtgaatatcatgttgtgcagtgtccttacattgaaaaactctgtttccagggcaccaaacatctctgatgggattgtacttcttgtgtattatactttctcaggaaattgccttagctctgaaagatatttaggttagcctcaacttactggccagaattgtgctgtatgtagtaaatgtatgccttaggccagattaaaaaaaaaagataaaaaatatttatgattctttttttttttaaacttcctggttctctaaagtagatccagaggggctatggaacgttttgtttttttctgttttggcaatggttgggcctcatggttatagtcaagaagggcctgatcattctgctaggaataattttaatcataaccatgatcttctgttgcatcagacaaattactgacaggcctccaaagtatgacctatttggtttcatggtaaactggcctattttattgctcaagtcccaaaaagtcaaggaatggaggtgaaaagtgtgtctcctggttacaaaagtgtggctcctggttacaaaagtgtggctcctggtcacaaaagtgtggctcctggttacatctatgtttgaattttcagacctaacgttaggggattataaagcctttacctggaagttcctcacaagcgaaaactgccctccccacaccagatgtggtgcacagccagtgcagtgcatcctctgaaggaagctgcagtcaaggattctgttcccgcgggccaacaagctcttacacatatttccattcttagctctggtaccttcgttcatagttctccttttctgaggttccttatgggaaggaggaagaggaaaccttgaagactcttccctactatctcagtactcattatttttctgcccctcttttcgcctttccctgggccccagggtccataaaactacagcctccccttgtctgggctacctcaacaatgaggactaccacatctgcgccaacactcctgatccttgaaccagtgcacctgttccatggggcaaaatggaaaaggccctttctcttattttagcttcttgcttttactatcaaggtaagtgatcaaagtcttaatagttaaccatcattttggcttgttgttgctataagtgactactctgacacctggcagctcagctctctctccagctgagctgagttcccaacaggtaggtacatacataaggaactaaacaataatttagggattaaactacaatatcttgagcaatggcctacagaaatgaatttataaagaaaacagagtaaagttacataatttattaaagaaaaaatatataaattatcaaactaaatcatttatgatgaaaaattaatatttatacaaatactacagacaaaagctactgacaaatactctgaacaagtaagtcaggttggtgggg

SEQ ID NO: 13095 - DNA, 601 bp, Homo sapiens
ttttaaatatctatatacttttaccataaacattttcatgctatgaaagttgttattaatttgtccatattcctacctaatttataaatcactggggctaaaggatatattattcatggtaggcaaacagttgcatcatcacacctaaattttagtaattattaaaagtccaacatgggtgttctttggtacaccttctggtacacattcactcttctggaatgttctcgtagtagcaatgactcaaggaccttagtgcttatctgcttgtctcttctaggatttgactttgtcagagtccttaacattaaactcgcagttggggaaagtacattacatatgctctccctccctttttctctccgcctttcccctgctctccccttctcacctttccttcttttaatgaacaagccctgacagtgatgtgcaatatttcaatctacattttgctggctaggacttagtcatatgctacacacatcactcttgcatacaaccctttcagacaaaaggtctggattaaagtaggcagcaatttttttaaatgtaaagttgtgatgacttaatgagacagcaacaccaaccaaataaactaaaa

SEQ ID NO: 13096 - DNA, 2214 bp, Homo sapiens
aaacaagtaaaatatctaggctagcagagggcgaagagtgagattatttctatgtgcatcatttatggctgaaaaatagaaaaatgacgcaagtgatagcctcagcaaaacatctgcatgaagtaaaagaggtggctgtttagtgaatccccataaaaagagaggggaaaaaaggtctgtaacagtgaaattatcctaactcaagggatgctcgtagcatggtgcctggcacctggtgatcttctgctgcttgtgattataactctcccaagaaaggaagtcacaggaagcatgtccactgtatgccagtgtgaagcccagccagccatgctcccaaagggccactttacccaccacagtcccaaagcagccaggaaggctcaagaaggaacaaggaaggccaggtgggtggccttggaggactctgctccctttcatccatccccaggctgggggttaattttgcagctgcacccccagccaatgaattgttctcaaagtgcatggaaacactgctgttggaaaaactgtgaagaaccataagagggcaagaaataaaaatgctgaaagaagccagaccccaaaagccaccatattataggattccatttacaggaaacatccagaagagaaaaatctatacagacagagagtagattgccaggggctgagggaaggagcttggggagaaacaggaaattgctactaaagggtctttgctttctttgggggtaatgaaaatgttctaaaattggggtgatggttgcacaaccctgtgaatatattaaaaaccacagaatggtacacttcaaatgggagaattgtgtggtatgtgaattatatctcaataaagctgtcatttaggaaaaaaaaaaacagttgccttggctctaaacttacttctccaattcctctgagaatgccaaatcactgccatctctctgattagggctgaattcatttcacagtaatttttaaaagagtattttctcaacacctgaaataggccctttgatgtctgtccaaagccctcctgggaattcttatctatttaaaagagggaatgagtattaagagcttggctttcctagctagccagacatccatgttaatttccacatctccacgttactatggcaacagagagcttccactgagagctttttggggggcatcaaaatggactgcaatttggactcagggagtccacagcccctctgcccagcagcccccagaccctggctaccttgaatcaggtgaaacagagaaatcagagaaggggaggatgtaggctccactgggtcttcactccatcctggcccaaactgagtcaccgtccccatgcaggaagagaagtgttagtcacatctttcagaggctgtgatctaaaacagcgtattgagcacctgagtcagtctccatgtcaacatgaccatatttttaggcaggagtaggcagcttcttgggccaattagagtagtacagctagaaagcagtcagtaaacagctgggagaaaagcagtcagccactgggagtccactgttctcacagaggagtctcacaaatgcagaagctccctgccttgaggtacccaaagagtccaccacataaggcccaggaggcctgaagtccatcctgtcaggcagaatcaatcactgggacagagaagggaagaggcagtgcataagacaggcagcctcaaagatgggccccactgatcctcatctcctggtgagccttatgtagccccctcataccttgaaccaagattgatctgtgttgtggccaatagagtacagcgaaggttaaattgtgccttctgaagctagatcataaaagacaccacactcttgggtcattcatgctggagaagccagctgccatgttgagaggacactcaagcagtcctacggggcagcccacatgagaggaactgaagcccccagccaccagccatgtgagccaccttggaaatggagccttcagcaccagtcaagctttcagatgattgcagccccaaacactatcttgacttcaatctcaagaacgtctgccagctagaaccatccagctaaactgctcccagattactgacccacacaatataatgtaaagtaaaaaatgtttgctgttgttttaagctactaagcattggggttatttgttacacagcaatggataacagacatagggtggatgtcagaaattgtctc

SEQ ID NO: 13097 - DNA, 2214 bp, Homo sapiens; identical to SEQ ID NO: 13096

SEQ ID NO: 13098 - DNA, 318 bp, Homo sapiens
ccaccaggtatgtcttttcttttttttttttttttttgagacggagtctcgctctgttgcccaggctggagtgcagtggtgcgatctcagctcactgcaagctccgcctcccgggttcacgccattctcctgcctcagcctcccgagtagctcggactacaggcgcccatcaccacgccaggctaattttttgtatttttagtagagacggggtttcactgtgttagcctggatgatctcgatcgcctgacgtcgtgatctgcccgcctcggcctcccaaagtgctgggattacaggtgtgagccaccgcgcctggcc

SEQ ID NO: 13099 - DNA, 308 bp, Homo sapiens
tcttttcttttttttttttttttttgagacggagtctcgctctgttgcccaggctggagtgcagtggtgcgatctcagctcactgcaagctccgcctcccgggttcacgccattctcctgcctcagcctcccgagtagctcggactacaggcgcccatcaccacgccaggctaattttttgtatttttagtagagacggggtttcactgtgttagcctggatgatctcgatcgcctgacgtcgtgatctgcccgcctcggcctcccaaagtgctgggattacaggtgtgagccaccgcgcctggcccc

SEQ ID NO: 13100 - DNA, 2701 bp, Homo sapiens
gccaccctcagaggctctgctctctgcaaagccctctgagcccttcaaagcctggagagacacggctgcttggggacatggctgctaatggcatcaactgcagtgagtcctggggtacgtgctttattccttccttccaggaggagggagccacacattgtaatagtttttaggaatttgaacctccaatgaagagggaaggaagatgtgtcctccacatgcacccctcctcccctcccagcagactttctttctttctttttttaagacagagtcttgctctgttgcccaggctggagtgcagtggcgtgatcttggctcaacgcaacctccgcctcctgggttcaagggattctcctgcctcagcctcctgctgccctcccagcagcctttctaggagatggagatggcgtgaggtccccgagggtctatggggccttgtctgggtgttgctctgctccctttctgcggagtggactgctctcagaggctcaggcccacctctgctgcatatcagcttgtgcaccaccaggaacgcaatcaatttggccgcagtgagctgaccaaggggttttgaccatttgcttctccaatctgaaaaggccccccagccgactgggtcttagtagagaaccctcccacctcgtgccccaggcccagcacatggcatgctgcaggggcaccccggcaccatcagcattcctggctaataccacgcagcatgaccttccttgccgtccagattgcagtggcctgggagatccactctcgggaatggatgcctgcattcagccaaacggccggccgcctcacgcctttcccagtgctgaactgcagaagggagaaaaggctcgaaaatgaccgcctgcccgcatctctgctcacttctcctctctccagctctctcccattcatttaattcatttaagataattcagagatcaaatgttcctaagggcaccatctatttatcgagcttatccgtgacttggaagcttaattggttggctgcggggcaagctgcagctccaggcagcctgaacctctccagcattaggagcaaatgggaggggaaacaaccgttactgtgttttatgatgccggtgccattagagataatgttatgtctcttgaaagacctcaaatggtatcccaacagcgagagacataagggtacacaaaccaggctgtttcggtcgacatgataaatgaatttggttttaaactaagaagaaggggggctcgctatagctctttgtaaatggcagccatgaatcctggctcctgcctttgccatagtgttgggcccccttgggtcagagcttggtgctaatgaagccagggtctccaacagattggcaaaaatatttaaatgtaattatccagctccgtggcaggtctcctctcccactggtaatttgcttagtgctataagcctgagttctttgggacttatacgaagctgagggtttggcaaattcttagcaccattggtgttccatgggttatacgcccaaattccttcttattcattcaactggatttttatgtaatttatgtcattatcatagctctctacctctttgccaatacagtcttgaatctgttagaaatatttggaaattaggctttgtgcaaccaaggatcagaggctgggcttaaaattacaccaaccctcaaattcacttcctaagttgattttccagtaagtaccccctgaaagcagaatagaagtcaggcccaccccaacctgtcctgctatttacagaggtgagaatgaaagtaaaagactgtcccatctgagagctttctggaatactaatcacctccctttgatcctgtctttcagccaaaacttggaatgggatgtgctccttctaactccccctacattagacaaaagcaaggggctctgtcagaccaagttccagcccaggtacaatgtgtcctgacctcgctttcctccctgaagtcaaggagttcaaaaagctacccttttcagaggtctgaggctgggtcctgggcatgaggacccaggagacccttccaagtgcatgtggcctcaccttcagtacatacatcggccggttttcaaacgaatgtccaatcttcaccctcctcgccaggtcaggaaagtctgcggcaatgttgtccatctcgtggtaaatctgaagcatgaaagagtgaatccagggacattttaaaaatctgcttatctatggctggatatctgtgatttaccttgttgatcttaactatctcttccgggaccctaatcttggaattgaccatattatcggcatggaaacgctgattatgagacctgcctgaatagtccttttctacaattttctggagagtagcacacttgtttgttcacaaaattgtagtccactaaactagagtagagaggcttttgcaatattgctctaacactgtgtcctttgtcactgtactagactggacagtcaaagacaagcggccaggcacagtgactcatgcctgtgatcccagcaatctgggagactgaggcgggaggattgcttgaggccaggagtttgagacagcctgggcaacatagtgagaccccatctctacaagaaacatttaaaaataaaaatagttcataaaaaatatggaagagggaaggaaagaaagaaattttaaaatttaagaatagtaataataaaataaaataaaa

SEQ ID NO: 13101 - DNA, 100 bp, Homo sapiens
tagagatgtggtttcaccatgttagccaggatggtctcgatctcctgacctcatgatccgcccacctcggcctcccaaagtgctgggattacaggtgtga

SEQ ID NO: 13102 - DNA, 141 bp, Homo sapiens
ttttttttttttttgagacagagtctcgctcagtcacccaggctggagtgcagtggtgcaatcttggctcactgcaacctccgcctcccggtttcaagtgattctcctgcctcagcttcccaagtagctgggactacaggt

SEQ ID NO: 13103 - DNA, 1505 bp, Homo sapiens
tccccatgctattctcatgatagtgaacatatctcatgagatctggtggttttataaaggtaaagttcccctgcatatgctgacttgcctgctgccatgtaagacgtgccttgcacctccttcaccttcctctgtgactgtgaggcctccccagccatgtgaaactgtgagtccattaaaactcttcttctttataaattacccagtcttgcatatgtctttattaacagtgagaaaatggactaatacattaggtcatgagggtggagctctcattaatgggattagtgccttatgaaagagaccccagatagctctcaagctctctttctgctatgtgaagatgcaacaagaagttagccatctgcaacctggaaaaaggccttcaccagaacctgactgtgctggcgccatgacctccagaacaatgagaagtaaatgtctattatttataagcccacccagtctgtggtactttgttgcagcagttcaaactaagacagcaacaaatataatttaaaaaaatatttcaggcaaaagccctcaatggattctaagattaatgggtgcaggctgggtgtggtggctcatgcctgtaatcccagcactttaggaggccaaggtgggcagatcacttgaagtcaggagtttgagaccagcctggccaacatggtgaaacctcatctctactaaaaatacaaaaattagctgggcgtggtggcatgtgcctgtaatctcagctactttacttgggaggctgaggcaggagaaccgcttggaccccggaggtggagattgtagtgagccaagatcatgccactgcacttcagcctgggcaacagagtgagactctgtcttaaaaaaaaaattaaattaaactaatgggtacagattggataaggaatgggacttgatatagtttgagatcctccccacagaaaacaatgggaaaagagtaactttacagtggatagaccttgtagatgccaccttaatcaagcaatcgaagttaacatcatcagtaatggggcaaattgaaatcatgcaccacccgataagatgcagtgagaagaacatggcatcacttctgtgatattcctacctcaagttcataacttgaatctaatcattaggaaacatcagacaaacccaaaccaagagacactctacaaaatcatgacctgtgatcctcaaaatttacaaggtcatgaacagcaaggaaagactgaagataaatgcactgtatgatactggattgggtctttttgtgacaaaggatatttgggacaaatggcacaacataaataaattgtagtaaagtgtttatatttttatggttgcattgtggttgtttaggtgaacattattgtaggatttacacataagaatattcatgggtgatggaatatcgtgtcggcaatttaccatcaaatgcttcaggaaacaaaactgcttcgcactattcttggaacctttctataaacttgaaattatttccaaataaa

SEQ ID NO: 13104 - DNA, 1504 bp, Homo sapiens
tccccatgctattctcatgatagtgaacatatctcatgagatctggtggttttataaaggtaaagttcccctgcatatgctgacttgcctgctgccatgtaagacgtgccttgcacctccttcaccttcctctgtgactgtgaggcctccccagccatgtgaaactgtgagtccattaaaactcttcttctttataaattacccagtcttgcatatgtctttattaacagtgagaaaatggactaatacattaggtcatgagggtggagctctcattaatgggattagtgccttatgaaagagaccccagatagctctcaagctctctttctgctatgtgaagatgcaacaagaagttagccatctgcaacctggaaaaaggccttcaccagaacctgactgtgctggcgccatgacctccagaacaatgagaagtaaatgtctattatttataagcccacccagtctgtggtactttgttgcagcagttcaaactaagacagcaacaaatataatttaaaaaaatatttcagcaaaagccctcaatggattctaagattaatgggtgcaggctgggtgtggtggctcatgcctgtaatcccagcactttaggaggccaaggtgggcagatcacttgaagtcaggagtttgagaccagcctggccaacatggtgaaacctcatctctactaaaaatacaaaaattagctgggcgtggtggcatgtgcctgtaatctcagctactttacttgggaggctgaggcaggagaaccacttggaccccggaggtggagattgtagtgagccaagatcatgccactgcacttcagcctgggcaacagagtgagactctgtcttaaaaaaaaaattaaattaaactaatgggtacagattggataaggaatgggacttgatatagtttgagatcctccccacagaaaacaatgggaaaagagtaactttacagtggatagaccttgtagatgccaccttaatcaagcaatcgaagttaacatcatcagtaatggggcaaattgaaatcatgcaccacccgataagatgcagtgagaagaacatggcatcacttctgtgatattcctacctcaagttcataacttgaatctaatcattaggaaacatcagacaaacccaaaccaagagacactctacaaaatcatgacctgtgatcctcaaaatttacaaggtcatgaacagcaaggaaagactgaagataaatgcactgtatgatactggattgggtctttttgtgacaaaggatatttgggacaaatggcacaacataaataaattgtagtaaagtgtttatatttttatggttgcattgtggttgtttaggtgaacattattgtaggatttacacataagaatattcatgggtgatggaatatcgtgtcggcaatttaccatcaaatgcttcaggaaacaaaactgcttcgcactattcttggaacctttctataaacttgaaattatttccaaataaa

SEQ ID NO: 13105 - DNA, 290 bp, Homo sapiens
atttatttatttatttttgagacggagtttcgttctgtcacccaggctggagtgcagtggcatgatctcggctcactgcaagctctgccttccgggttcatgccattctcctgcctcagcctcccgagtagctgggactacaggcgcccaccaccatgcctggctaatttttttgtatttttagtagagacagggtttcaccatgttagccaggatggtgtcaatctcctgacctcatgatctgcctgccttggcctcccaaagtgctgggattacaggcatgagccacc

SEQ ID NO: 13106 - DNA, 618 bp, Homo sapiens
ggtacaattgatcccgtcacctggggtacagtacccaataggtagtttttcaacccttcccccctctagtaatcccccgtgtctattgttcccatctttatgttcatgagtacccagtgtttagctcctacttataagtgagaacatgcagtgtttggttttctgttcctgcagaaatttatccacttaggataaaagcctctagctgcatccatgttactgcaaaggacacgatttcttcttcttttcttttcttttgtttcttctttctttctttcccttccttccttctctcttttctttctctttctctctctctctcttttctgcatccatgttgctgcaaaggacatgatttcttcttttttctctcttcctttctctttcctttctttttttctttccttcccttccttccctccttttctttcttttactttttcttcttttgtctttctttcttcttcttgagtcaaagtcttgctctgttgcccaggccggagtgcagtgagtggtgtgattttggctcactgcaacctccgcctcccgggttcaagcaattctcctgcctcagcctcctgagtagctgggattacaggtgtgtgccaccacgcccag

SEQ ID NO: 13107 - DNA, 618 bp, Homo sapiens; identical to SEQ ID NO: 13106

SEQ ID NO: 13108 - DNA, 5516 bp, Homo sapiens
gaggcagcgctggcggcggggctggggccactgaggaaatccatccgcgccgccgccgccgccgccgccgccgccgccgcctccgccgcggaggaagacagcgccgcccgcgcaccgccagcgacccccgccgcagagtcccaccgccacaggtaccttcgctggcaaaaggagtcctctcgccccccagccccaatttcccccaggggaacctctcttccttcggtctcccggggctggcctcctgggagcggacgtaactccccagacctccgctcccttcccctcttgcccggtcgctcccaaacccggaaggggaactggggaaccctcgccccccaccgtgcgtgcgcttccccgcaccatcagcgaagtttttgcccgaccccagaccccagcccagccccgactgcctcttgctccctcggaagttggggggctaaattccgggcttcctctaggccccgccccgccccctttccccaccgccaccctcccgcctgcccccggggagcacccctcgtgtcctccactgtcgcacccctgccggccctcgccttgcacaactccaaaatcggggagaagcaggcaaggccgcgcgccacccttcctttcgtctccaccctacccacgatttgggtgctgcccgtggtttctggccccactcgccgaaactggagccctcggcgccctattccctttacagatcctcaccccaagcccagctcccaggcgcccgccccccgcccagctttcttttaggcaaaatggaggtcgtaggggctggagggccaggcccactgcgcttcgcagcgccgcaccagcccgcgccttccagctgccagatccagggaccctcccgtcactctcctgagccccgccagacctgcggaggcggttgcaccctcatttctctatggagcgccggctgctatatccctagagtctgggggctgctgagggccctggggggtgatggggaccgagggctgagaacgtcgcccccgcccccagtttcttcctccagccgtgcttccttctgccctgggcctccggcggtgccgccaggcctgggctgctagtaggtggaagaggctttgtgcgggcctgggggttgggtagagtaaggagttctgcccgcaccccccatcccccgattttgagggtcaccccttggcactggcgtagaaagctgaacttacaaggaggggaaatgtcagtggggaagaggaacgccctgcgcctgggggaagtgggagctgggtgggggacgcctgggccggccaagtgcagtgtgtacggccggatcgcacaggtgtcccgcgggcggggaaggactcaggctcccggagcggagccagccgggcccctggggcccgggcgccgagcctgcgggctgggccccccgggtgtccagggcgccgcggccaggccgcctggggccgcccgcccgcgcctgggagagagcacctccgcgcctcggggccggggacctcgttgcggagccgtaattactcgagagcggctcccacgggctttctgcgggcgcggcggggcgggcggtccctgcgctggagggagcagcggctcggggctgccttccccgccgctgtcacccccacccgcggcggacggctaatggggcgcagccggaccggggattatccggggtgagccgtccagaacctattagcgcccaatcggcttttcccaaatcctgtaaacagccacccgggccggttctggggagggcgggaggctgggtcgggcgggggcgatggggccgggggtggggtcacccaccctacaggtctctgccgtggatgcggttgccttggcaacggggctagggtgggggcatttcaccaatgaggtgctctcggtccgggtgacggttgcctaggcaaccccacgaacagcccagctttcccctctggtctctccccccacccgccaccatcgaagctgggggtgtgtgtggagggtgtgcgccttgtggggtgaatttcaagaggcaccgccccttttaaaattaggtgcttggagggcggtgcctgtgcgggctggggcagaagccaggtctgttttcgaagggacacccccgccccccccgccccagttcctgccgcgggtgtcctgcccgggctgtgtccgagggaggggtttcccctgcgcttcctcttgcacttcccgctccgtttccggggggcgggaggaagattggggaagtcggctcttactcggcgacgtctctggtgccggagaccctggttgtgcccggggacggcggccgcgccgccccttccccctccccttgcttaccccttccgggccgcgctgcaaccccgcctttctccccacttccccggcggcctcgggcctgacgtcagccctgcatcccccaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggtgagggcctggtgcggggcgggcgattcatgtgtacaccgcccggtgccctggaccgggttgggtgagggtgttggtgggggaagggggagggagggccccttaatggctcagaatctgaccctgtccactcctgtcttctgttctcttctctccctttcctccccaacctgtcttctctcgcgtctctctggctctgccatcccttacaggatgcccgaaaagcatgtggggactcaacactgacccaggtgagggcacttggtggccagagcgtaactaggggttgaaggggcaaggatcagaggccgctgccctctgcagtcctgctgcctgggcctccccgagcgcattctgtctctacctccagatcacagctgggctggacccagtggggagaatccagatgaggacccggaggaccctccgtgggcacctggcaaagatctatgccatgcactgggggaccgactcaaggtgtgtgtgtgtgcgcgggctggcgctgtgggccgactttctagcaggccgtgggagcagcctcagatctggcggagtaagcaggccaccaaaatacccagcgtacgtctggaaaaacggtgactcccagacatgtccgccagacctggacaggcaggaccatgctggtgagaacttgtgggctgcagctggagactgtctctcaggtggctcacgcctgtaatcccagcacgtggggaggccagggcaggatcacttgagctcaggagtttgagaccagcctgggcaacatagtgagaccctggctctactaaaaattgaaaaatgagctgggtgtggtggtgctcaccttgtagtcccagctatgcgggggaggctgaggtgggaggatcacttgagcctaggagttccaggctgcagtgagctgtgatggtgccactgcactccagcctgcacaacagagagagaccctaccttctcccacccaaagggaagggggtgtgtcttgttttcacgccacccttctgctctccctacaccgttccccaccaggctgctggtcagcgcctcccaggatgggaagctcatcatctgggacagctacaccaccaacaaggtagggtggcgcgggctgcggggtggggcagggccacagggccctggctggctctgaccccggcgcttcccctgctccgcaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactggtgaggggcctggcccagttcgggccctttttggggttggggggtgcactgccctccgtgtggagacctggctgaccagctccttccccagggtacctgtcgtgttgccgcttcctggatgacaaccaaatcatcaccagctctggggataccacctggtgaggctctgccagggctgggcagtctgggcaaacccacacttcctgcctcaggggccaccgtcccagtgctcaacatgcagcatgcaccgtagcctccctctcctggtgggcgctaagggggtcagggagggatgcgtcccctccccacctaaggctctgagaagagcctccctggacccttccacagggttgggctcacgtggtggggcggggagaacagggactctgttcttcgccctgtctcttatcttttctttcttcctgtcacctctccagtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctgtgagttttggggcgagctaggccaggccctccccaccaggctcccggccctgctcctcaccctcaccctcaccccatctgggtcccgtgtcctgcagttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggtgacagctggggcccaggctgggtgggcagggacctggagcccaggcccaatgggttctgacttctctcttcttcacaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgtacctggtctctgcccttgctgtgttctccttgtttctggactttgttgcctgagggctgctgagggggtggatggtggggaaggtatggggcctgccaggcagctggggctgggggtgg

SEQ ID NO: 13109 - DNA, 386 bp, Homo sapiens
gcccatctgcctcctctatagattgcaagctccatgaggagggtgcacctgtcattcaaggttgcatcctcattgcctagggcagtgcctgatacatcatccggttcagtaaatatcaacggaatgagttaaaacaggaaagcttattagcacagaaaccaaagcagcacacatgccctcttgagattgacaaaattgtgctgtagtcctgcgctgcttgttgttaagtgactttagggaagtcatcgtggccatctacagattgaggaaatcaacgtaattatctctgaggtccctcccaaattctcatgtgtagttgacatctgttatctattgcttatatgtcactgaattggcaggtatgcataaatagaatttgcatctaa

SEQ ID NO: 13110 - DNA, 386 bp, Homo sapiens; identical to SEQ ID NO: 13109

SEQ ID NO: 13111 - DNA, 150 bp, Homo sapiens
cacgcctgtaatcccagcactttgggaggccgagacaggcagatcacgaggtcaggagatggagaccatcctggctaacaccgtgaaaccccgtctctactaaaaatacaaaaaattagccgggtgtggtggcacacgcctgtagtccca

SEQ ID NO: 13112 - DNA, 736 bp, Homo sapiens
gggctgagcgggggatggggagagaagagggatagggccagcaaggcagggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagac

SEQ ID NO: 13113 - DNA, 736 bp, Homo sapiens
gggctgagcgggggatggggagagaagagggatagggccagcaaggcagggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttttgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagac

SEQ ID NO: 13114 - DNA, 475 bp, Homo sapiens
gtcttaactcatttccttgaagactacctttaaactccatcagggaattttagtcaaaatttctctcttgccatcaggagtgcatttgggtttgtttgaggggaaaagggtttgtggaagagcatgatgaatatttgacatcataggaaagacagtctttgcagtggatatttagagggaaaataatcgatgcaaggaatggatttagggaaaatgcttctttagtgtctaaggagaagcaagaatttgggaagtgacacgggtgtgttgtgctggcagttggtgactgtgtcctttgaatctcaatttgctctccagggttcacaattttcaattttgaaagaagccacatttaaaacacttcttgaaccttaaagctttaagatatttaaaatgtcaatttccttggaatcatgaaatagtatgtgaaagcattctctgattttttgaactggcaagagaggactttgacagg

SEQ ID NO: 13115 - DNA, 475 bp, Homo sapiens; identical to SEQ ID NO: 13114

SEQ ID NO: 13116 - DNA, 1431 bp, Homo sapiens
ctgagttatggtagtcatgagagcatctgatagctcctctgtgactcatccatttattttaatgacatctgaatatgacagtatattgaaaaaagaatgcatgttatttattccatactggggaagtgccactataacattgttttaaaaaatcttcaaaaatttcctattagaacctatcattgaattagaaaagcaagctttgccaaatgcctgattatgcctttactggtcctgctagctggcatgtttcaccaacttttccctagtgtttcctttggcactgttgagcccacactacaaaacatgaacaagtcccacaaaaccacactatgccctctgcttccccatcatgtggggaccatctgcctggacatccactgtggggtagcaggaagaactttggcctgggtggacacatggggttaattatctgtgtgtctttggtctatgatcaccgcattcttccatttgttcgaccctcagttttcctgcctaccagtaatgccctatgactcctccagctctggtatctgggatcttgagtctgaggggcaggtcacttgttgctatgggcttctgctcccagcaaaggcagtgggtgactgcttgactttagggttcagtctggcaatagctttgtttctggtgaagggaaaggttagatcatcctggtcctggcctttcctgaaggtcaccctggggctcttttcccccaccttttttttccctctgagcttgggagttatccctcttcttgcccttcttctcatctttttgaagcatcagacttgagttccttgctatgagattgaaaaggcaaaactgtcttctaacaagggccttttggcatgtccataacagcaacaacaacagtaataataacaacagcatcttacatttaaggtttttagtttacactttacaaagaacttttaaatacataatctcatcggccatcgtacggccccttggctgagttgaagagaacttcttttccctttcctgaatcctgctcaggggggacacagcttgagcggcctcttctgcccacgtacattgccacacaaacactgaaccacactttttcaggagcaaattaactgaactcttcctgcctcatggaatgtcctgtttctagaatgtgactgctcaaggagagagcgttttaatcatcatttgttagaggagcctcatttcggggagaattttcttaatggtccttgcatttggcatttcttaaagtcagggcttccaaacttgagggagaaggctcaaaattataagggacagacctggcccttttgctgtcttggttgatgggggctggattcaggattgggcccagggtgatgagcagagggaggtctcaggttccttggggaggcagagggaaagctggcagcctggtgactcctcccaggaagccag

SEQ ID NO: 13117 - DNA, 2504 bp, Homo sapiens
ctgagttatggtagtcatgagagcatctgatagctcctctgtgactcatccatttattttaatgacatctgaatatgacagtatattgaaaaaagaatgcatgttatttattccatactggggaagtgccactataacattgttttaaaaaatcttcaaaaatttcctattagaacctatcattgaattagaaaagcaagctttgccaaatgcctgattatgcctttactggtcctgctagctggcatgtttcaccaacttttccctagtgtttcctttggcactgttgagcccacactacaaaacatgaacaagtcccacaaaaccacactatgccctctgcttccccatcatgtggggaccatctgcctggacatccactgtggggtagcaggaagaactttggcctgggtggacacatggggttaattatctgtgtgtctttggtctatgatcaccgcattcttccatttgttcgaccctcagttttcctgcctaccagtaatgccctatgactcctccagctctggtatctgggatcttgagtctgaggggcaggtcacttgttgctatgggcttctgctcccagcaaaggcagtgggtgactgcttgactttagggttcagtctggcaatagctttgtttctggtgaagggaaaggttagatcatcctggtcctggcctttcctgaaggtcaccctggggctcttttcccccaccttttttttccctctgagcttgggagttatccctcttcttgcccttcttctcatctttttgaagcatcagacttgagttccttgctatgagattgaaaaggcaaaactgtcttctaacaagggccttttggcatgtccataacagcaacaacaacagtaataataacaacagcatcttacatttaaggtttttagtttacactttacaaagaacttttaaatacataatctcatcggccatcgtacggccccttggctgagttgaagagaacttcttttccctttcctgaatcctgctcaggggggacacagcttgagcggcctcttctgcccacgtacattgccacacaaacactgaaccacactttttcaggagcaaattaactgaactcttcctgcctcatggaatgtcctgtttctagaatgtgactgctcaaggagagagcgttttaatcatcatttgttagaggagcctcatttcggggagaattttcttaatggtccttgcatttggcatttcttaaagtcagggcttccaaacttgagggagaaggctcaaaattataagggacagacctggcccttttgctgtcttggttgatgggggctggattcaggattgggcccagggtgatgagcagagggaggtctcaggttccttggggaggcagagggaaagctggcagcctggtgactcctcccaggaagccagtgaccctcggtggggctcttgagatggcaggctgagtaggctctgggctgggtggggagaggctagcaggggcattggtggtgggataaggctcagatccacctgcctagggggagaggggggatggggcaatggaggtggggatggggaaatggaggttgggaagggtgttgggcagatcccaggatcctcttcaagagcagagcttgtaagctaccatagacatttgtgatccatctggccggcagtgttttctagccacagagtaaaccacagggagctctcaagtccattttgggtgacagctctgtctcctctttcaggcctttatgctgccacagctctcttcctaaaccagagcttgtcttgctcttcccttcctcaaacaaccctgctggcacctgtggcccagtttagcatgcacagctctttgtggtcaaaaccctaccttcctacctaccccatttctctctgctcctcagtgtgcttcccatactcttgccaccctagattttgactcttccccaaacaagccaggcctggccatatctcattgctttttaaaaggccactcccaggaaagttcaattccctttctcactctggcaaactcctattcatccttaaagacctaggactagaagttccctcctctggacagccacttccattgcttgtattgccacttaagagctccttgtgtaataaggcaattgtccatttttatgactgtttttgtcacaggctgtaggatcctcaaaggcaggatgtgtttctttcccatgagaagcaggatggtttagtggttgagtgagcaagttctggagtcagacagcctgggcccagatcctggctctacggtttattagacatttactcttgggcaagttctttaacttctctgtgtctcagtctactcaactgtaaaatgagttaatagtgttttaactacatggttgtttcaataattaaatgaatatatatctatttcacaattagagtggtatctgatgtataataaagtactaaataaatctgctattataataatgtttgaaacaggctgagcatag

SEQ ID NO: 13118 - DNA, 2504 bp, Homo sapiens
ctgagttatggtagtcatgagagcatctgatagctcctctgtgactcatccatttattttaatgacatctgaatatgacagtatattgaaaaaagaatgcatgttatttattccatactggggaagtgccactataacattgttttaaaaaatcttcaaaaatttcctattagaacctatcattgaattagaaaagcaagctttgccaaatgcctgattatgcctttactggtcctgctagctggcatgtttcaccaacttttccctagtgtttcctttggcactgttgagcccacactacaaaacatgaacaagtcccacaaaaccacactatgccctctgcttccccatcatgtggggaccatctgcctggacatccactgtggggtagcaggaagaactttggcctgggtggacacatggggttaattatctgtgtgtctttggtctatgatcaccgcattcttccatttgttcgaccctcagttttcctgcctaccagtaatgccctatgactcctccagctctggtatctgggatcttgagtctgaggggcaggtcacttgttgctatgggcttctgctcccagcaaaggcagtgggtgactgcttgactttagggttcagtctggcaatagctttgtttctggtgaagggaaaggttagatcatcctggtcctggcctttcctgaaggtcaccctggggctcttttcccccaccttttttttccctctgagcttgggagttatccctcttcttgcccttcttctcatctttttgaagcatcagacttgagttccttgctatgagattgaaaaggcaaaactgtcttctaacaagggccttttggcatgtccataacagcaacaacaacagtaataataacaacagcatcttacatttaaggtttttagtttacactttacaaagaacttttaaatacataatctcatcggccatcgtacggccccttggctgagttgaagagaacttcttttccctttcctgaatcctgctcaggggggacacagcttgagcggcctcttctgcccacgtacattgccacacaaacactgaaccacactttttcaggagcaaattaactgaactcttcctgcctcatggaatgtcctgtttctagaatgtgactgctcaaggagagagcgttttaatcatcatttgttagaggagcctcatttcggggagaattttcttaatggtccttgcatttggcatttcttaaagtcagggcttccaaacttgagggagaaggctcaaaattataagggacagacctggcccttttgctgtcttggttgatgggggctggattcaggattgggcccagggtgatgagcagagggaggtctcaggttccttggggaggcagagggaaagctggcagcctggtgactcctcccaggaagccagtgaccctcggtggggctcttgagatggcaggctgagtaggctctgggctgggtggggagaggctagcaggggcattggtggtgggataaggctcagatccacctgcctagggggagaggggggatggggcaatggaggtggggatggggaaatggaggttgggaagggtgttgggcagatcccaggatcctcttcaagagcagagcttctaagctaccatagacatttgtgatccatctggccggcagtgttttctagccacagagtaaaccacagggagctctcaagtccattttgggtgacagctctgtctcctctttcaggcctttatgctgccacagctctcttcctaaaccagagcttgtcttgctcttcccttcctcaaacaaccctgctggcacctgtggcccagtttagcatgcacagctctttgtggtcaaaaccctaccttcctacctaccccatttctctctgctcctcagtgtgcttcccatactcttgccaccctagattttgactcttccccaaacaagccaggcctggccatatctcattgctttttaaaaggccactcccaggaaagttcaattccctttctcactctggcaaactcctattcatccttaaagacctaggactagaagttccctcctctggacagccacttccattgcttgtattgccacttaagagctccttgtgtaataaggcaattgtccatttttatgactgtttttgtcacaggctgtaggatcctcaaaggcaggatgtgtttctttcccatgagaagcaggatggtttagtggttgagtgagcaagttctggagtcagacagcctgggcccagatcctggctctacggtttattagacatttactcttgggcaagttctttaacttctctgtgtctcagtctactcaactgtaaaatgagttaatagtgttttaactacatggttgtttcaataattaaatgaatatatatctatttcacaattagagtggtatctgatgtataataaagtactaaataaatctgctattataataatgtttgaaacaggctgagcatag

SEQ ID NO: 13119 - DNA, 703 bp, Homo sapiens
tcccttcctcaaacacccctgctgggcacctgtggcccagtttagcatgcacagctctttgtggtccaaaaccctacccttcctacctaccccatttctctctgctcctcagtgtgcttcccatactcttgccaccctagattttgactcttccccaaacaagccaggcctggccatatctcattgctttttaaaaggccactcccaggaaagttcaattccctttctcactctggcaaactcctattcatccttaaagacctaggactagaagttccctcctctggacagccacttccattgcttgtattgccacttaagagctccttgtgtaataaggcaattgtccatttttatgactgtttttgtcacaggctgtaggatcctcaaaggcaggatgtgtttctttcccatgagaagcaggatggtttagtggttgagtgagcaagttctggagtcagacagcctgggcccagatcctggctctacggtttattagacatttactcttgggcaagttctttaacttctctgtgtctcagtctactcaactgtaaaatgagttaatagtgttttaactacatggttgtttcaataattaaatgaatatatatctatttcacaattagagtggtatctgatgtataataaagtactaaataaatctgctattataataatgtttgaaacaggctgagcatag

SEQ ID NO: 13120 - DNA, 7705 bp, Homo sapiens
gacagggacagcaatatttttgagtggcagtgagactgagaaggccagggctcagcagcttttcctggaagaactgggcattttgggcactgacatccaggactccgaaaagctgggtaattttaggggaggaaaaataaaagggagttaaaaaacaagaaacaaaggtcttttccttctctctcttcctcttattcctttttctgatctcaatgagcagctcttggtctactgccgacataataccgtttcataaacatgaaaacatcttcctccttcctcagacaggctatcattctttattcttatccttttgttttaaagcatttttattagtctatttttttcttaaatttttaaacagctatttttaaaaacacaacaaatacacaacacaaaacttggtaaaaataactcactatatggtacatatacgcagatggtgtaatatatttatataataaaagatgaaaatagtcactttccataataaaaataagttctattttttgtttattttacaatatacttaatattctcttcttctttaccttcctctccagcttcatttccttcatgctgaatcaccagggggtcccacatggctgtcccaactccatcaagctggagtccgagaggtggcaggcaggcgggcaggggcttaggaacacgcgaggcagccgcactctaagtgtctctccacctcttctacaaacgaggagccgtccgtgcactggaagacgtatttccgccgcttgctgcgggtgggctggcagcactggggcccacagcccccacgacattccatgatgggcaccttggaggctgtggcacatgatgcataacctttctggcggcggatcacctctcggactacttgtcccaggcacggattctctgcagagggcatagaagtcagggcattggtggtctaggtggccagcaggaccatgagcagttcccaggtaggctgctttgaaatacttgtgctctgaagactgtaagaatttattcactcatccatctgcctaccctcccctccatccacccatctattttacaaacaggtgcctttcctgtaccaggctctctgacaggcttacacctaagccgtgaggatataatgatgacaaaagcaggcttggtcccttccttcaagaaacctaaagtcaaaactaaaactagatgacgcaaactgatagactgtgggccaaatcctgaccccagaccaatttggatcaccctacatgtgcctaaaaattaattaaatgtcaacattcaaaaagcaggagatttcacctgaaaatctggatttctgccttccttgaaaacaaggaggtctggcagagctgagcctgcaaccctgcactgcagtgatggctgaagctgagtgctttagatggggcaggcaatctccagtttgccccagtcactaccactcccaatagtctgtctctcttggcctagagtctagatactatttaagtgaatatatttaataaagaaactgaggtagatgctataaagaaagggaagatgttcatacaagaacatacagtatatgtttttgtatgctataagacatttgtattcaaaaggcatttgacctggcccaggggccagggaggcttctctgggaaatgagctggagttgatatctgaataagaagcaggtgttgcgatgagcttttccagaaggcctagaaataactgcaggctgggaaagggcacccctgtatctgcttaaacactctggaccctgacccagcttttcatttccacccctctactgtcctcactacagtgggagaatgtctgcagcaaggcacttgaggaagggagccatgacccttgacccttgacaagcaagtcacagtttccgtgtctgcaaagtggtaacacatttacctgtccttccagcaactcccaggctgttacgggcaccagaggcgattgtgaaggagaaagggctttatgcattttaaagcttcaggtgttgttaaaagtctttaaaattatgagattgttaaaaggattagaaagaggttaatgacaatgtgtgcatgtgcatgtgtataacatggggagagacagggagtgcagatggggcaacatgctaatgactggggtgaagggattaagctgtttatactgtcctgacagtttttctgtaagtctgaaattatttcagaataagctatttaataacattttaaaaatgagttttggttaagaatagtatttcgtgtaggtataaaatgtggaaaagtcctcaaggcacggggtggactgcctgggatcctggtggcagggagcaagacttctcagtgtccatgcaggagaaagatcccccaaggtaagacaaccattttaatattaatataatttcctttgtttaggtcagaccaaagaactggcttctgctgacccagtaagggcaagagggttggatggaggctgtggagcaatgccatcagcttggatacatatgcgaatcattgcaaaatgcaggttctgactcaaaagggctggggtggggcctgggagccccaggtgactcccaggtgatgtcagtggtgctggtcaatgtcagggggccactctgagtggctagggtttcattagttttgaaggcatggcatctcaagggccaacagctggaaaagaggagaaaagaaccatccagactgctcatgtgttctccctgcagaggtccactgaggaccattttctacacttgtttcatctttaaaaagtccatgctttagaatcttaactttggcagtatgagttatctgcacttttgtcttttcttggagacagggtctgtctctgtcacctgggctggagtgcagtggtgcattcattgcagcttcaagctcctgagctcatgcaatccttgcacctcggcctcccaaaatgctaggattccaggtgtgagccaccactcctggccctatctagatgaggaagtgaaccacaagtatgctgctcaatgtcatgcagagttgagacaggctctcactctgtcacccaggttgatcttggctgactgtaacctccgcctcctgggttcaaatgattctcttgcctcgcctccagcatagctgggattacaggcgaccgccatgatgcccagctaatttttgtatttttagtagagacagggtttcaccatgttggccaggatagtcaaggtcatgcagattctaaatgacagtttggccttcatcgtgacaatgttgcttctgactttacatctcaacatctcacgtactcctcccaacaaccctataaagaagcacagtagctagcctccaagattgcccccagtgactaccaccttctggtattgatgccctttatgtggtcccctccctcactgaatgtacctgactgatgtaaccaatgcaatgtggtggaaatgatggtgtgagtgacttccaattgtaggtcatacaagacaagtggcttactctcttctggaccattcactctgggacatgccagctgccctggcgcaaggaccctcaaagagcctgtgtagtgactcatgcagggcagaactgggacctcccgccaacacccagcgccatgggagtgcagcacattggaagcatatcctgctgccttgggttagcctacagagaactgcagccatggctgtgtagaatgcaaccctgagagatcccagctacgctctttctgaattcccaacccacaggaacaatgtaggctaaaaaaaatgttttttgtggttttgaactgctatggtttggggctaagttgttatgcagcactagataactgatacaggaaggtatagtattgcctccgttttcaagttgagggaattgaggctcagaaagtgactgaaccaaggtcatgcagcctttaagtggcacagccagaactggaactgaggtgatctggatgtgaagtccaactctgacccccacttcctccctcccacaggcacagtagacccaccttgttggcagtgctcgccgctaaagccgggctggcacaggcagtagggctccccttggtctgagatgtggcactgcccatggtgacacttgaaggctgagcaggcattggcagagtcattcttgttgtcacacaagtcccctccatagccctcggcacacttgcacatgtatgaggtcccagttgccacacattttccatggtggcatctaggggcagagaggaggatgagaagggaactggatcagagttggtgctgctggggactccctctgtccacccagccagggaccaggggacccggagctgagtacagtccaatagctttctctgtttcctaggctgagcatctcttttcttaaccaccttggttccccctggccaaccagccagaagcctgcgagtgtcacccagtgtccactgtgagctgtgaccacagcagaggctggcttgctgatttacacacacacctcatgcagccaagtagcaaacaactgcttgaaagaatctagccattctctaaacattttaattgctttaccatcttaaataagaattactaccaccccactactaccagcaggtaccactggctatgtaccaggaattgtgttaagtgctttacacccagtattgctctgaatttccatcataacctcttgtctgctgctcctatgcagtacatttcacccatgaaaaaaaatgaaggtaaagcctatattctgaatcatgatgcaccactgcccctattgagatgacatgcagagccaggatccgtattatagagtcaaacacacacacacatatgctcaagagcaacacaagaagctcaaaccctgtatagctgtcccttattcctgatccaaaaaatcatttcctgactggtttagccaaccacatttccagtgttggctctggtgttagttttggctgattcaggtttcttaacactgacagtactggatctcctatatttagcatgaggcctggcacgtagtaggacctcagtaaatctttgttgaatgagtagttgcttaaactattaaatgtggtttgatgtgtggtatatacacctggtgccttgcacaggctgagtctgcccatgtgggtgccttttttaattcccacagagacagtgggggctcacctgtggctctggacaggtttaaaggccgacctggcagagactagtgtttgagcagggccctcttatgctgatccctccaagcaggtctggctgctcagatgtgtaagctcagcctcttgacctcttaagcagttacacgttacacagatcctattctgccgggttctgactgcaactcctccagcctccagtagtgcctatttctcaggtggggtagggactgaggccattctgggagctcgagcacacagccagggctcctgggacactgacctgtggccgaggcaggggtcccgggcctcctgatcgcagagtgggccggtccagcctgggcggcactcgcacaccacgctgtccttctccacggagcggcacaggccgtgcttgcacacggtgcaggacttgcagcctggtgacacccccagggactgtggtgggagggccttgaagtcctgcagctcgttgttgatgcgcacctcatggatgcatccgtggaagccgcctagaggccggtccgtgccctggcgcaaggcagagaggccggtggaggtggggatgcctgtgggaggggagccaggacagtggcctgaagaccctcccctgccaccctgctgtcctcagagcgaaaaagcacttttcacacattcatggccagaactctgggcctctgctgttcaaacgaggttaacgggccaaaacctcggacctcctccatacagggacgtgcatccttggtcctgcactgggactccttaaaaaaacgtgaatttgttgccaatatgtaatattagaaaatttcccataaaaatttgtatcttggacttccctagaaaaaatgagatgatctggtcacccattgccctatgatcccactggctgaactgaggagaccgttccccccaataggcaagtgcaccaaataacctgctgtccccaccaggctcctcagccctttgatccaggcctcacaagagaatccagggcaggtgagctacagctgaggagataagataaggttttggggagctgcttgatcaacgaaactttggggttcagggtttttagaccagtttgctgccttatgtgcggtgtacccctcttctcaggatcttcaagagactgttagtaaagacctaatttgcttttcaataatttgtattttcgctccccttctacaccattccctgcccaccttctatagttgagagcctgggactggcctggaagcagggcacccagttccgttctgggtgcacctggagcaggtggggcacagggcacggtcctcctccagggataagtggtgtcccttctggggctgccctcggcacagagctttccctggcctccctacatctgaaccacccattaacaacaccctcttctgggcccgtgctagtctctgcaggtggactctgggtaaagtcttgggaatcttaggattgaacgagcagttttggtagctttttttacacttaaccccttgagaactatcagtgcaggggctgcatttcaggcccagagtctgcctaactgatggctacttttttgtgttttgttgttgttttaaagacaaggtctcactctgtcacccaggttgcagggcagtggcacaatcatggctcactgcagccccaacctcccaggctcaagcaatccccctgcctcaccctccaaagtagctgggactacaggtgctcactactgtgcccagctaatttaaatattttgtagagatgaggtctcactgtgttgcctaggctggcctccaactcctgggctcaagtgatcctcccacctcagcctcccaaagtgttgggattacaggtgtgagccactgcacctggcctacttccatttttggcctttgattttaatctcaaattcttctacattcattaattgaacctccgagggtttgaggaggtggcagagcagagggaatatgacctgaagctggcagacttcagcagagcctagaccctgcttccatctcctgcctcccccttctcacccttgcccgtcacaacgtgtagtttccaggagtcctgttctctttcctttccaagcacctgtcccacattctctttcctccatggcctggctagtgcttattcaccttttagagatcagcttcgttgtcccttcctccaggaagccttccctgattggctttggcagtggcctgggtttctgtactggagcacagagggccagagggaggtagaggtggtagggaaagagggcattacctccaaggtagagggggctgttgatgcccactgctggctgcttctggagcttccccaggctctttggagttcctttgtccactactaggttcagggtctggtttagcgtcaccagctccacactgtgaaactgcccatcattcactgtctccacactggccagtagagaaggggagaaagccggagagttcactaagggccttccatggctgggccctgtgctgtggacttgacctgcattgcttacattttgttttactttttatttggaaataactttaaacttacataagttgcaaaaataaaaacagtacag

SEQ ID NO: 13121 - DNA, 10088 bp, Homo sapiens
tcccacctcagcctctagagtagctggaattataggcacaagtcaccacacccaactaatttttgtattttttgtgaagatagggtttcactatattggtcaagctggtctcaaactcctctgacttcaagtgatctacccacctcggcctcccaaagtgctgggtttacaggcgtgagctaccatgcccagcctacagttcatcctgtgcactaatctgtttcactctctaaatgaacaaagtgggagatcactgtcatggccaaagttacatggccaagacaaactatggcctgggagtcccaggttctcctgtgtgggcactttcctggcatatgctaaatgatgggaaagtctgggtctcatgtttctgtgtggtcctcacctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagcttctcacatcgttgttggggatgacggactgtagttgatgggttagcggaatttcaaactgatcacctggggatgagagcaatgggtaactgaagcttttgggctcgggggacaggtcagtgcccacgttgttgtattcccattttgtctcagtttgtttaacagttggctctaagttgaatgcagtcctagtgggaatctgcctcaggaagatgattgtagtttgtgttttcagagatggtgccttctggcatagtagtgttttccataaaaacgttttcttcagaggcatttcttgcagttgtgttttttacagtagtgttttctataaaacattctgaaggagcaaatacttctggaaaagggttttcttgaggactcaggtctcctgaggatgaaaaagccccttgtgaaggggaatttatgaggctcttcactgcagagaacggcggcctctttgcgagcatcagtctattgagataacttttctttctcaattttctaatctttttggccttgggtgttctgtgggccacacgggagtgagttttatgaaagtggtatttttttctggaatgtactactcgtttagcagccttcatattttttaactctagcctttgcattttctaaaattaaaatggtgtaggctaagtctttcaatctgtctatgacctgaggtagggcttttgcagttgtggaaggcagaaggcatgcccatggagaagggtttcagcaaagaggagactgttggcttctgctcttgggtgaatgaaggcttggtgtagacggcgtttcccgctacgttctcgggcccctgcactatgtgaggctattccagctcccttggggctggactcccgagccttttttctttggcagcattctccccaaatgcctgggcaccctgttccctcctgatactctgctttcccaccgctttgaagggccttttctggatgctccttgggcccatgaggactctgttcactctctgcaggtttttgcctacactttgaacctttgccaggctgttttcctgtggttggacagtttctaatttcttttcaaatatttggcatttaaatttgttacctagaaggctggactgcataagcatggcagttttttcttcccttttaacttcatcgatttttttcttgtatttctgcatctaacatcttttctagcaaatacacctttctcaatttattttcataagttgaattgttggatgcaggttgaaacaaggggctctttgtattgtttttcaaaacaggagcttatctccatcttgcacatttgaaaaaagcagtttaatgaatggtaacaacattgattccgcatctagatttcctgctgagaaataaggcaagatgtaatttagcgcagtgataacatcactcttatcataagtgtctagctgctcactcccaaagactgacaagttgatgccactgctgtctgaggctgcctccggctcagtagtcagctcaatgctcatgtgcttcttctgggcttgtaacaccttcatgaacactctttctggattccctacagatgcttcttcacctgtcaaaaaaaagagactgctttgatcatgaaagataatggaacggcatgcatcagtccacagctgtatgccccagtcacacaaagtaggagtcagcaaacattagagtgccattcagagaggagaaacacacacccaagcctaaatctatgaaatggcaacaacaaaaggaggaaaagacatcttttgaaaatatggctacttacttggaacattcctagtgtgacatagagtaactctgcttaggattatttcgttgatccccaggggccaattgcccagtgctcagtcaaagcccaaggtggaagacaagtgcttccctgatgagctgtcctctctgcagactgctccgtaccctgtgctgtcctgcctcagatgcagagagagcacaagcctccctcctcatcctcagtgtgcctgtgttcttactaccatcacagctgaatgcaatgaaaggctatcctctgagaggagcagggtggagatgctaaagtggaggccccctcccattgctgatagatcctcatctggcatgcactccacccacccaccccattctctgctaccacatatcgtagccccattaaagaagaagtgacatggaaaaaacactgtgcccaccctagtccttttcttaaatttgggcagagatccagggtataggttaagagatttttaatttgccagatggtatgcctatgttgttaaatatacaatgaatctatggtatgatagcagtttctggataaacattacttgaggtcctaaaatgcagaagggaaaaagcagcttttgtcagatgcttactttgctttcatttcatctctaatattttggatggggaaccatccaaagcttctggccgcatgaaggtcaagtgtgccagtgtgcagctgggtttcttttccagaattaaaagtattttgggtggtgctgagggtcagaggaagaagtaaaaattgtgagaaaggagaaacatgggcttggggagaacccagaattggggacagaagacctggcactaagctatagcacttagcacctctgatcttgtttttcctcgtccgtaaaaggagattaacaatgcttttctgcccacctcttggggagaagggaataatttagttggtaaaaaaaaaacttttgaataataagcaactctgtctttatataagtagccaagcattattaattatccaccccatatcactggtagatacctgtattcaagctatgtggacataaaagcagtcacattttagaagtcatgaagttggtgctaataaacctaatctacagaaaaactcttgaaagcacttgagcatttgttctgtgaatagaaaggtttgagattcagagcaagttcagagttggatggtctaagaatggaaaagccctccattccattagaagagccagggagcaatttctggttatggaaccagaagctctcaggcttcaaataaaacagcatcacttgtactcttataaaattgtaaaaacaaaaacaaaactggatctacatttgtcctaaaaggcagagagtacttgagacctcatgcatataaaaccagcttacaaactacatcgcactatatgaagaaattatcactgggggcaaatcaccaagtagggagcacaatacacagggtgtggatgttaatgtcattccctagccttctcattcccttctcttggtcctttatgcatatggaacagttccattattaaattttgtaataataactgagaacctgactcccagcaagggagtagttcagaagttgagggagtttaaatctgaatgagtaaataaagcaattatatcattagcttaaaattttatcatcaattaaaaataaatttaaaaacaaatacttaaaataatgtaacaatttatcaccaggcaatttggactcacgacaatgtgtggtgtttgtcagacatgcactgttgcaatgcagcttgactgtcttgcagacagcctcaatgctatttttaaattggcagaggcagcaggccatatggctaggtaagatcctataagatgaaaacacaaaacaataaatagtggtaaagcagttacttgagtaggcaaaggaggcaggccaacgctaccacagggctgggcagaaaggtgttactgaggcctgtggactggacagttgggtaggaaccagaagggcaatgggaaggaggacaaaggtgcccaactgaagggtaagcatggcagtgagtatggtatgcctagaataaaagtggttgggattagaattgggtgacactgatcagtagtttaattcagaagtatctcttcccaactcaaaagtctcactttgggctgaaagtacacaggaagaaagtagacttctaagaagagtctgaataagcccccaacttctggagtccctttctcaatttctgttggcagtgggaaatattagaaattactctgggcattaaaaatagctcagtttaacctggattgtggggttaaaaaaataacagattgcattggccaaatctcgacaatttgagcattcaaaagagtaacaataagctacaacataattaatatataaaaaagaatccatgaagaatgatatttaaaaagagagggagttgttctttaatgaaataatgccagctaatgaatgtagaaggaatgacagaattttaaaaagtgttactttgcaaccaccaatgtaataaaaattgattcagacaaggattgtcattgatggacacagctgggtgagaagacatttgagaacaggatctttactgatctcaaagtaccaccacacagatattttattaattaccaaagggaaaaattattttttatttttttatgagacaaagtctcactctgtcacccaggctgaaatacagtggcaaaatcgtagctcacaacagcctcgacccccaccctgggctcaagtgagtctccaaattcagccccccaagtatatgggactatagtcttgtaccaccacacccagctaatttttttttttttttttttttttttttgtatttttagtagagacagggtttcaccttgttgctcaggctggtctaaaactcctggactcaagcgatctgcccgtctcggccttccaaagtgctgggattataagcatgagccaccacacccagcaaaataactacaatggagagatctggaagatcaccttaaacaagtgatcaaacttagcattatgagccacctgcaatcacgaggcaggaaggatatatcacctatgcagtatttttcccaaaaatgcttaccttgaatctcatcatgtggaaacagacaaatccagattatgggacaatttacaaaacaactatctttgactcttaaaaaatgccatgtcatgaaagatcaaaaaaagtagaggaatgttttagattaaaggaaatgaagacatgacatgcagtgcctaatctttgattggattctgtgctattctttcatctttctggtatgtttgaattttttttgaaatataaacttgggcaaaagagataaccaagataattgattaatttattgttatggctcattgggggcagtttcagagaaataaaaacaatctttgtaactggagtaaattctcaaggttaatcttaagcaatatagcatggtcattaagaatacagattccacagccagactaggcttaaatcccagctctgtgaataatgtgaatttgggcacattgattaatctctgttccttggccttgtcattataatagtacctacctctaatgagttttgaggattagatgaatcagtacctgaaaaatgcctgacacacagtgagtgctcaataaatgttaactactgtaattattacattacagaggttgtgggggggccttttctgagtcctccaaaaggatgactttattagggccacattaagactgtggaaacagaagagtattcaacagataaatgaagtctatgagttgggggtacaatttatggagttttagattaaaactgcatccaataagttggtctgacacatctttcaaacctatagaggaataatcacaagtgactagtattcctttgggtccaatagaggtctctgatcttcatacagattgaatgtacccagaaccgtaacctagcattttacttatatagcaaccttaactctgacacaaaagtgtttcttttgttttgaggccaagtctcactctgttacacaggctgagtgcagtggtgcaatctcacttcactgcagcctctgcctcctgggctcaaatgatcctcccacctcagcctcctgagtagctagaactacaggtgagtgccaccatgcctggctcatttttgtattttttgtagagatggggtttcaccatgttgcccaggctggtctcaaactcctgagctcaagcaaccctctctccttggcctcccaaagtgctgggattacaggcatgagcctgaagtttaattgttattcttttcctgcccccgacttttgattttaaacattttctttttttcctttaagccttaggatggctaggaagcattttcagatggtataatgaacacctgtataactttcatctggaatcaacagttgctaatactttgccacatttgctttccatgtgtgtatgtctatacattttctggacaaaccatttgagagtcagttgcagacaaaatgaccctttgccattaaagacttcagtgtgcagcccctaagaagcaaggcattctcctgcataaccagaggactatcatcacccaatggaacttcatattatcattgtctactatgcagcccatatacacattttcacaattgtcccaatcataacatggcttaaaaaattcagaatccaatccaacatcagacattgcatttagcgttcatgatttttttttttttttttgtagaaagacctttaatacttctgtttacaaaattcaggcatacatttcagtttgccctgaaccgtgcccaaggctgtgtgctcatctctgccaggatgtctgtgccctcatgtactgctgacgtggagggtgcagagcagagcctggggtctggaggcttcgctgggcctcagggggaggggaatgtgaatgtggcccggcccagaggaccctccatttcatcagttttggattgggcaacagaggaagcagatgtctgggctgcagacctgctggtctgggcaggggtttgggaaccccggggttgcctgccatggtctagaggagatggctgcggctacttcccacagggtggggtggccactaggggcttgaagatttgctcactggagcctttgtgcttggccctcagcagcacagctggggctgtggtcccgtgcaaggtgtgctgagggttgtgtaggtggctggtggtggcagcttgtgccagagtgacacaggcttctgtgggcctggctgggggcagttaaaaagccgaaaaggtacttggctttgtgagggcaaggcttgggaggcggggccctgcaggacgtcatgttctctgtcctggttaggaggggggaggtgttgggggggggaaggtggggcagatcccaactggcccctgtccctgggctgcaagctgacagcaggccagggaagcagtgaggccttctgccctggccttggggagaaggagtgcatgtgtgaggctgggatacagtggccctggagtggggctagggctcatcgccagcaccaggcgcggggaggatttaaaaccagagtcctgtctctgagccaccccacagggacgcttgatccaagcctgttaaggccgtggaactcgagggtaggcagtgggctgggccaccgtgggttcaggatggaggtgtgggggctgccctggaggaacgttagtgtttctgagagcaccttagtgttgctctgcctcagccagctgggcaaggagttggggagcggggaggaggccggcgccatggagtggggaagggagccgtcactgttggggatcagccgctagtgtaaacgagcatctccacccacccagataagccccccacccaagtgtggagccctgctcagggagtacctcaagggccccggcctgggtggcgccagcaggcttggacactgccctggcagcaggggccccgtggaaggcaggatacccagcagggggtgccacccagtgtggatggaggggcagggcgggggcgcccctgagtcactgggcagaggcacgagcacgtccacatagctgagcaggaagaagcccgactggccgtccagcatgccctcgtatcagttctcgttcatctggttgatcagcatgaagacatcgccctcatggaagcccagctccctatctttctccggctccaagtcatacagcccttgcagctcggctggtctaggggcggcatgctcctgctaggagtccagatggacttgtcgtaagatcggaaagaggacgaagctgcgatcttggggactgtggtgcaggggaagccccggttggactgctcaggctttccgaggtcaaagcactcccggggcttgggcttatactcccgcctgggtcgtgaggaagcttcccggatcctgcacttgaacttctgggccagctggtccaggatctgcacggcctgccggtggtagtccagctgcgcctctgccaaggccgggagttgactcacctactggatgtcggtctccaggaggttgtgcatgctggtttctgccacctccttggactcctcaaacttctccagcgcctggtgcagctcctcttcggggatcttgccctgccgcttcttttagtcaaagtccaggcggcggccctccagcttctgcaggtggtgctggatctccttcaggtctttctcacataggttctggagggggtcaatgaagttatgcttgacctctatgtccagggagtccttcacctctgccaggtgcttcatgggctcgccggcatccagcagtgcatcgctgaagttggactcgtcgcgcagctccttcccatggcggatcaggcactcgcccaggagcccccctgactgcaggtagccggggttcttcacctggccccggatcttgcacgcggtgttgagcatggtcagtttagcctgcgaggctgggttgggctgcgggtactcgatggtcctggacagtacttacgtcaccgccttgctgatgacatccaccttctccatctcttcgaagtcatcatccagcttggtcccctcagcccctccgaccttctcactgaccagttggctcgccttgtagaactgcttcttcagcccggcaaccgacatgctgcctcctgccgcggaaccttccgcccagacccccctgcccagaccccgccagcgacaggctcccgggcaccaccaaccctctgcgcgcctcagcggcccccatcagcaccgcctccaccacccgcttgccagctcggcgcccgccccggcgccgcctcgagttcatgattctttagtctccttcaatctagatctgttcccaggattgtttaaaagcatactgacaaacctttgagactgtaaatgacctgaggtatacattatctttacttgagaatagtaatttttcaatatgcattaaagatcattacacatgagctaagacaaatgagctggtctacttactttgtatataaatgtgtaaactcctgaagacttccaataatgaactccaataaggcaattagttcaatgtctttatggccttggcgacaaatggttacagacaatgagagcatttttcctatacactaatggtcaagaaaaaagcagacagatcctcactatcttagagaactaagtgagaaagctggtcagtgaagaggacttcatccagagaggaagggatctag

SEQ ID NO: 13122 - DNA, 132 bp, Homo sapiens
tttttttttttttagacggagtctcactctgtcgcccaggctggagtgcagtggcgtgatctctgctcactgcaagctccgccccctcggttcacgccattctcctacctcagcctcccgagtagctgggac

SEQ ID NO: 13123 - DNA, 3412 bp, Homo sapiens
tttgtgtgagcaacaaggttgtttatttcacttgggtgcaagtggactgagtccacaaagagagtcagcaaagggagatggggtggagcagctttataggatttgggtaggtggtggaaaattacagttaaaggtagttatctcttgcagacagggcaggggtcacaaggtgcaggatggggagatcatgagactcattgtccaggggaggaatgtcacaaggccagttgattagttggggtggggcaggaacaaatcaccatggtggaatgtcatcagtgaaggcaggaactggctgtttcatttttttggtggttcttcagttgctccaggccacctggacgaatacctgcagatcacaggggttaacgatggcttagcttgggctcagcggcctgacattgaggatccttctttatctttttctgatgcccttctatgagaatgaatatgttttggaagaaaatgcaattaagattatccatcacaacaaccactatctccaaatctgtattcattgcttctattcattattcattataagtctcatctacctgatgaaataacttttttgaagataggaattgtatgctgtttaacagtgctttgattcttccacagttcagtcatccttgatatcttgcaggggattggttctaggataccgctgccacgccataccagaatctgtggatgctcagtcccttacatataatggtgcagtatttgcgtataaccaacacacatccccccatatactttattgacttagagacaagatcaccctctgttgctcagccggagtgcagtgtcacaatcacagctcactgcagcctcaacctcctgggttccagtgatccgcccacctcagcctcttgagtagctgggactacaggtgcataccaccacacctggctaattttaaaaaaatttttatttttagtaaagacaagttctcactatactgcccaggttggcctcccaaagtattgggattacaagggtgagccacggtacctggccccatgtactttaagtcatcactaataaaatgtatagatattgtacaatggtgacagttgttatgctgtcttttctatttgtatttttattgtttcttttttcaaatattcagcctcatctagttgaatctgaagatgtggacctgatgatgaagagggctgactgtatctaacttagggtcttgcatgcagctggcacttaatacattttattgactattttagctaacattcaacagacaattcctaataaaaaactcttaaaagtaggaaaaaaagtccttcctctaaagtggcaggaaaatcagcctaggcaacatagcgagaccttgtctctacaaaaaaaattttttttaattagctgcctgcttgtagtcccagccactcaggaagctgaggcaggaggatcccttaagcccaggagcttgaggttacaatgagctagatcacaccattgctctccagcctgggtgacaacaaggccctgagaaagaagaaaaaaaaagaaaaaggaaaggaaggaaagaatataagtattgaaaaggaagagacaaaactgattatttgcatatgaaatgataaatgtgagacagccaaggaagcctaagagaatcaactaagtttgtcttactggaagtaatatgagaattcaatacagtggctatataaaaatcaagacagcagcacacagacctcaactacttttcccatgtaccaccaataactaattagaaaatggaaggaagatcccatttacaatagcaatacaaatgtatggagtatttaggaacaaaaatgcaaagatcttttatctaacaaaaaatatataaaatctatatgatgaaaaccctaaaactcttctgaaagacattaaaaagaaatgagtacatgaggcagcacatttctagaatgttgtacagatgtcaattctcaaattagtctacaaatttaatgtaatcctattcaaatcctcagatagtttttggtggtggctgtttttgagacagggcctcgctctgttgcccaggctagagtgcagtggtatgactacagatcactgcatcctcgacctcccaggctcaagcaatcctcccacttcagcctctgaagtctctcatatggtgtccgagaaatggggacaaatctcacaaagggactaggctcaggagggctggaatattcagggaaggtttcaagcagaaagatgaacttgagttggcttttgagagattcataggattcccacaggcagagtgaaataagggaattttagatgaacaaacgcacagacaaaagcagaaatgcagatggtgtgactgggggatggtgaggggctgctctggctggaatggagggctggctgccacaatagtggaaatggtaaatgaggcaaataaggttggattggtaggatagcatcaaggttgccagcttattaaatcactcttccaatatgctagcactggcctattgggaaaagtaatgcatcatgtaatcaaacaaaaggcaaacagaggcaagctccaggaatgggcactgtaaacaggactcaccctagagtggccagatgtagactttagatatgttaatgcaggttgagcatctctaatccgagggggaatgtctcatatggtgtccaagaaatgggcacatctcacagagggcctagactcaggagggctacagtatgagacatttcccctcccttgtgaacttaaaaatgtggccaacaatttttttaaaagatggttaccctgcagtgctttaactggacctatttagacaacgccttacacactggagaaggatgatactttgtgactctaataaatctaccagacaatacttctctcttttggctgtctccttcctctccagggtgatgacaactccgtgagggtggagattatacatctctcatcatttcagcaacaaggaaataaattagtggcagagtaagggtgacttggtgagtacatccaattgttgacatagttttgggtgggagaaattttgctattatatcaacttcttaaaatggtctagtgggattaactttgtttcaattcacagagatctcttggaagcgaggatcctttaaaaatcctggaatatacactgcagtaaaagaacaaagcatacctcagccttaaacgactgaagaagaatgtcaagtggggaagtggctttggttttcagtttgtgggttctgaatccacacaaagacaggattgctttctgaaaacctgaattaattattgtccttacctcaataagacaaaaaattagaatcaaaatcgttagtattacagtcacagatatcaccaagattagtttgttgttatagccatatcctggaacttctttcgtgagctaaaaaaaaaaaaaaa

SEQ ID NO: 13124 - DNA, 11766 bp, Homo sapiens
agcagccccgcggctcctcgggccccgccgcgctggcaagccccagtccccgccagcccaatcgtgctggcgctttaaggacgggcggggcgggctgggcgacagcgctggacacctggagctgcccgaggacgcggaggagaggtggggcgggcgtcaccaccggagtggagggcgaggcccgggtcccgcgctcccctgggcgccccacggcagcctcagagccccgcggggagcgcgcagccctcggggcgggcgccggggtgaggcctggctcggtccctgcgcaccgggtgcgggcggcggagagggcgcggctggtgagccctgggagggcccaggagccagacctcggttttgcgggctggggagcagggctcgggggcagcggccaggcccctccgcccctaacacccgcgcctcctgcagacccgagggtcgccgctggtagggtcgctcagccctggcgtcctccaccaccacaccttcacctgcgcccggctccctgcgcgcctggacagcgcctgctgcccgcctcccgatggccctgccccaggtgggtggaaacggccttctccctcctttacgggcactcagccccttctgtcgtcgaccttgccccgaccccttcccctaacctcggtcaccgtggcttggtgggcagtgtggacacccggggctctgcctgggttttatcttgctgggtggcttgaggccatggcactcagggcctcaattggggaacaagaacaaattcttgttcggacagtttcgtctttacagaaagcggcatctaaagtgcccttattggggcctggtgcggtggctcacgcctgtaatcccagcactttgggaggccgaggcgggctgataacttgaggtcaggagttcgagaccagcctgggcaacatgatgaaaccctgtctctactaaaaatacaaaaattagccgggcatggtggcgggcgcttgtaatcctagctgcttaggaagctgaggcaggagaatcacttgaactcaggaggcagagggtgcaatgagccgagatcgcaggactgccctccagcctgggcaacagagcaagatggaatctcaaacaaaacaaaacaaaacaaaaatgcccttattggtatggagtagggcacggagaatggcatggcgttccatcctggctttgtgcaggagtgggtgcaggagggaggctctgtcctccggactctcctgacaggagcagggcctttctactagacttttactgaagatgctgcccccttgccagggggcagatgatagattcaggctggccctgccaccagtgagcagatagggcaagatgaagggcagggacaggtgctgagcactgctgtggaaataaaaataatcataataagaataaattttattttaatatattctcattctgagaagcaatatggtattattgtgcccatttacagggaggacactaaggcgtggagaagctggatcctgccagtgtcagagcagggtgcatcctcggtccagccttgtgtccctgtgcctcacttacagcctgccgtcttgccatctcattttcattacctgctttccccttgcaggcagggatttgaactcagagatgctgggtggtcacagagctaacagggaatgaccactgtagtcagagggggtgatcaatggatgcatctgattcccggaaaaccctcctctggctggagggaggtgggggcagcttctgtagacagccttctgggaaggggtgcaatgagagtcctggatgtaagcagagggcgctccaggtggaaggagcacaggtctagtagagggtccaggtgaaaggagtttgggtgagaacagcctgctgatagtgacatccctgacctataataataaggaaaacaaccactgcacaatggaacaggctgcccttcatccagtggacattgaccttctccaccccaaccgtcccccaggatggcaggttagcatgtgccctgcctgctgtgggggatccacatggaaggagcgagacccacacagaaaatgaccccgaccccatgtgagaacacgcaaagggcagttgcaggggctagtctgaggcccgggaggagttaagctgggaaggagggccatgcattctaaagagtgagagctgcccgtgccaaagacaagtacatctatttgcagcgtggtctcaactttctatattaaaaaatactgatagacctagctgtacacacagacagggatttgactcagactagacctgggtccaaatccagcagtaaccctagtggacaaattgtcaccctattatggtcaccaattgtggagaaattgtcaccctagtggccacagtgtctttaggacacagtgctgttgtggggattaagtgaggggacacctgtaaagtccttggcatggtgcccagcctggtaaatgcccagcctgataaatgcacagcacacatctgctgctgccatcatcctgtatgcaggacaagggggcaatgaacaggaaacagccacctggggattttgctaatctttgagaggcaagattagtggtgatttgtgttttgctttgttttttttttttgtttttttttgagaaagagtctcactctgtcacccaggctggagtgcagtgacgcaatctcggctcactgcaacctccacatcctgggttcaagtgattctcgtgcctcagcatcccgagtagctgggactacaggtgcccaccaccacgcctggctaattggctaatttttgtatttctagtagagacgggggtttcaccatattgcccaggctggtctcaaactcctgacctcaggtgatccacccacctcggcctcccaaagtactgggattacaggtgtgagccactgtgcccagcctgtatttttaaatttttattctcttctgtggttttctcctttttccacaatgagcagcaactattgtttggtacaaagtaaaaagcagtgtaggttgccccacgcaggtgtgcctaggtgtgtgctcctccagtgctgagaaccctgctgtacctggctttggaccaggtccttcacctttttgggctcactctcctcatttgtaaaatgggacttttcatatggcctgcccacctgtagggaggcaggtgcgatgctaggtataaagggggactgttgagtaccataacatacaggcagtggttactgttcttgatttgcttgtgtgttttgttttttgaattttttttcccagaagcaggtttctcctcttgacagcctctcctagctctttgactttggggatgggggactgggagtagtcagaattttttgctccctacatgaaaaggctttgagctggagacaggaggcacttgccccctggacagattcacaggaagagaactgcaggtaatttacaaatggaatttctctatatgcatccagaggtctaggggtgcagaaagattgaggtccactcccagagcgccccttttacatgtgtacattctctctctctcacacacacatgcacacacacacacacgtgtgtttttaaacacatttggtaacatgcccttttgaaatctaaagtttcacctactgcatcttgaacatttgccatgcccttcagctcccatgggatcatgcctttgagcagccgcacagcagtatgtcatttggatatattgttgttggctgggcaagccccacttggaagggatttgtgatcactgaagcctctctttaaggtctgtggcccccgctgcctgcttcactggctcagcctctggaagaggagacagtgcttctgcaaatcctcctagcagcctcctagagagcctgccttttatccgatgaggaagcaggcccggggcaggtgagaggcttatcccatgatacagctgtagaggggggaccaaagccgggactgtccttcatgtccctgtgctgtggaagctggaatcctgcactgcctcctctctcccagctcttcacaactgtgagggtggattttcacccgaccagcattgatttatccagcaacactttccctcagttcagaggatttattgagcagctattatatgctaggcactgaggggatatagtggtgaacaaggccagcatggaccctgccctcagggagctcacagaccggggagtgggataagtgaagcagaagttaagcacaggtttctgctgtggcaaaggtggcccagggcacttaggggtttaaagttaaagtgtcttcagagaaggcttccctggtgaggctgagctgagccttgaggggagctaatgggaagttacaggtacagggactggaaggtacaatggacagcctagaaattggctttggggacaactcagacctaggtttccgcctcctacatctgtgtgatccggggccaggacccttccaggtttttccccccgtgcattcttttatttaattgagacaacactgtatgcataatttagtatactaagttgaaaaaagcaagatgtgataaatgtttcctcctcttgttaaacctttgtgctgagcttgattttttaaaaaaatgggctaatattaattattcattctagagattatgccatagtttactcaccatttctttacaattgaacattttagcactttccaaattatgaccattattaataaggccacggtgaacgtgtgtatgtgtgtgtgtgtgtgtgtgtgtgtgtatgtgtgtgtgacagagtctcactcttttgcccaggctggagtgcagtggtgcgatctcggctcactacaacctctgcctcccaggttcaagtgattctcctgcctcagcctcccgagtagctgggattacaggcatgtgccgccatgctcagctaatttttgtagttttagtagagatggggattcaccctgttggccaggctggtctcgaactcctgacctcaggtgatctgcccgccttggcctcccaaagtgctgggattacaggcgtgagtcactgcacctggcttgctgaacatctttttccataaagttttgctctatgttgcgaatttcggcctcagactcttcaatatccctctttcacacttgttctgggtctcggtatcttcctctattcagtaacagtgtccatctcacaagattatgaccaggtgaagtcaggcagtgcataaccagcaaaccctgatcctggcaggcctggaggttccaacatgcgttacttttctctgtcccagcttcctgtgtggcagtcagggtgggaagttttagacccaccaggcagatggggcccctgaggcctggagggaggccctgagtgaaagtggtcatacttagctcctgagatttcccagtcatggtgctgatacatgtttacctctgaccttcagaatagcccggcaaagtcaggggcatcatctccacttcacagatgaggaaactgaggcccagaggagttaagtgacttctccaaggttgtacagtgacctcaggcaaaggaattaacacctggcctccagcacctttcatatggcccatttcctcttctccctccttctctgtgtccagatgtgtgacgggagccacttggcctccaccctccgctattgcatgacagtcagcggcacagtggttctggtggccgggacgctctgcttcgcttggtggagcgaaggggatgcaaccgcccagcctggccagctggccccacccacggagtatccggtgcctgagggccccagccccctgctcaggtccgtcagcttcgtctgctgcggtgcaggtggcctgctgctgctcattggcctgctgtggtccgtcaaggccagcatcccagggccacctcgatgggacccctatcacctctccagagacctgtactacctcactgtggagtcctcagagaaggagagctgcaggtcagcagggcggggtgtggcagcgggtggggactgcaggtaggggcccagtcacaccagcccaccagccagcatttgtaattccagcaaattctcatggggttcctcctttggatcaggctttgccctgtgtcctgggtacacggaagctgatcagtacagccctgaaggagtttaaagccccatgacagaagctgatgatgacaaaccggagtaggtagtgctgtgtgagagaggcatggcttttaaagacatggagaaacccaggaaggcttcctggaggaggtggcagctgagctcagcttggtatgggacagaatagcagagggttaaaagcctaggcgcaagagtcagacccactgggaccctgttctggttctatcacaaactagcagtgggactttgagtaggtcatgcaatccccctaagctttaacttcctcatttgaaatgaaaaggactaatagcaacagcaataatagcaaacccctctacagtacagccctgtgccaggcactgttcaaagtgctcttccatactcgctcagctgatccttacagcagccctctgaagtagctactgttatgagttccatttgtaaaggaggaaaaggaggcatggagacactaagtaactcagccaaggacatcagatagtgtgtgtcagaaccaggacttgaacccaggcagtctggcctcagagtctatgctcacgcccactccctacttcaggtgacacttgggaaaattaaatgagatatgtatgttgagctttagccgagtgcctggtacacagtgggtgcacagcaaatgtcaacttttcctctagtggacatggtggaaaagaggcattttaggcaggcagaagagcatgcacaaaggtatggggttggggacaaagtgttgcatgaagacagcatctctcaaccttttattttcattatgggtctccccaccctgccttgtgccatccttcttagacttttttttttccaaatcctcttccatgaaattgtaacaccccagatacactgtgtatttgtttatgttctatatgtatatctgtgctttatacataaaaagagtattaccctccccaagaaccaatgtgtgtcctgttgagaatgcatgtattatgcatgcccttttatgtacttatgtattcaacaaagtacagagtgtgcctatgtactaggggcctgtgtacatcacctcctgtcttttctatttcctgcaaggtaagaatgactgttgtgtctgcagaaaaggaaggagaggcatagctagaaagtggcaggagcctgctggctgcacggctggcattcttcctcccacgtcagtcctaagccctggatccctgtgtgtgaggggctaagccagactgccgtgagctgctgggacctgggacctgaatgctcttcctccctgttttaacagggaaaatgttttccgagtcgaagaatgtaggagcattcctgctaccagcctgtgacttcttaaagctagagatgatgcagtacagtcagccctttctgtctatgggttctgcatccatgattcaaccaaccatggatccaaaatacttgaaatagcatttacatgtgtatttacatagcatttacatagtgttagatattgcagggccttggggactctccagccaaacccttcacttctcagatgagagacctgggtctcagaaagaccaagtgacctagctggtgatacagtgagttagtggtcagttggaaccaggccaggccccagatgctctggaccagagcctgctcctcccacccagccaggcgtgagtgcagggggtgggtgttgcctgtacacacagccatgttgttgcaacagggtctaggcacagctgcacctggcaggtggggccccttggccttcactcccagtgggccagggaggaagcccacctaggaggtcacagggtgatcgtagcccatcgagctccaagaccccagtcgtagactcaaaactggggggctgggggtcgaggaggctgcttctgctggaggtgctctttcctgtcctgaggctgactcagcccagccctgctgcctgcagagcccagcacctggcccccatgggtggctactctgctattcctgctcccaggcacctcagtctctggtggtgcccgctgtgggtaactctaggtcagaaataaagccttcctgggctgatggcttgggcaggtcccttcccctcttggcctcggtttccccgtttattcatctacttactctttcatgcatgtgcctaatattgattgagcacacgtaggtatgctgggtgctattcagagaactgacggtgccacagtgggcaaaacagacaaaatccctgccctcaggaagctcctatcttgagtgtaagtccccttagtgaggtggctggatgtggggcctccagtagtccctgctctttcttttagaagctgtgtgtccttgaggatgttacttagactctctgaggctgtgtctgacacctcttctctcaactggggtgaagaccttttccctatcatcgctgtcaggctcagatgagatgagagttagggaagcgtgcactctgtagctggtacacacatctgctttctctgctattcctgttttaatttacagtgcgccctcatgcccactagatttgagcctcaactgcttatgaggtaagtgtaaggattaggcccatttgacagctgagaagactgaggtgaggagagatgaggtggcttgggggagaggtgtgataggtggacttagcttgagctttgcagtcagacgaagctggggctttgccacttagttgacacatggcctttactcatctgtaaagtgggtgcaggcctctaccccccagggtggttgtgaatatgaaaggagattagagaacttaagtgttgggcaaattgtatttcatcccttgccccactcttcctgggtttgcctgactcagctgaaaggcagtggagctggtgccaggcccaggtctcctgccccaaccagactccaaagattggggtgagccctagcctccatggcacttcctgtgcggggagaccactgtggcaggactgccccacacagctgccgaggcgccatatccatgaatggggcctgctcccagaggggtgtgatgcagctgccctgcttgctgagttcctggcatcctcgactgtgaccttggcgacttggagctgggcgggcccagctggtcactaaggtgacagaaggtggtgtgagggccgcttcacatctgccctctaagcaaacttcctgctgtgggcagaactcaccggcacctgtgccctgccctgccagctgtcacctgctgggatggccccaggcctacccaaagcctgtctcaggtgtccagggctctaagtggggctggagcatggctgggaggtgagcaggcaggagatggggctctggaagctaattacttacacttttctgagtgttgtgaaacatttgtttttctttttttttttgcccctgaatctgaaaggagaaatattatcctcattttacggatgaggagaaagaggttcagagaaggtgtaaatgtggtccaggtcacacagcagtagaacccaacttgcctccttccaggaggaatattctctgtcctgccctcatctgcaaggatgctgggagctcagaggagggtgaggacaggcactatctcagcttcctcggctgtcttccagagaaggaagggaggtctgtgagagttcacaggagcactggacagggagttccatgtttgggactcctggctggtgtcccagggatttctggctggtgccctgccctgtactgacatacaggctggggttcaaatccaggatcccatcaatctgctccgtcaccctggtctgtgattgggagcagtgagcctcccagcaggctgctgtgaggctgcagtgggccgagaagacacattgccggagaaagtccaggtccccggtgggtgctgggcgttcacctgaggggcagcagcaggttccatctaccagcatgggcccctccgtcagctaagtcccatctactgcttcttctgttccccagactggcctcttgccattggcccctcctcggtctagacagcaggaccacaggtatggaatcaactgcttcccagcagctccaaactgaggagcctggcaagtgactcagcctctctcagccttgtggggcctgccatcttgaggcctgtgataagctttgctccctgacccattccccacaggagccccttgagattctgctcataaccccacttacgtcccgggcgctgagtgctgccctccgtgagcccatttaacctgcactctgtcctgtgaggcaggtgccactaccatcccccattttacagatgaggaaaccaggcctcgatgaatggaattacagacccatgatctcccagcaggaatgtgtccaagcagggaggtgaaccaaccagtgcccagactcataaccaccctcagtgttggaagggaccttcaggatcacccccaaagcaagagcagcccacacccaggatcagcgacattcccaccccactccccactgtgtgtcccaggttggggaggggcattggatccccagagatgacccgccagggctctgagggggccgacagctggtctcattcctatcagccttaggctggctggggcgtgggtgatctgtctcagggtctggcctgcagaacttggtctctgcctcaagcccctgtggggtggtttagttggccaggggtggggaccagaaaagagtcacaggatagcaaactgtccagagatagaagtggttgatctggtaagttgtaagctctccatccctggaggtatgcaagtagagataatcacttggcagacatcatatcaaaatctaaagcatccagatgggcagaggaattgaggtctcccattctgccctgggcatcccaattctgatcttgtaaaggatatttcaataggcgggagtcttctgtctatggaccaccatcactcaatctttcaacatgaaacacccataagcagctaccctcagcccctggactctcagtcactgccctagggtaggacttaccctgcagagagaactgaggaggcaccaggaggtgctgggagcacatacagggaactaattctatggcgcagggagtgggtggcgggaaggctgagggccacaggggctggctcatgccaagtttcaactgcgtatatgtgaccctggagagccacaaaggcttggagcagggtgtgaagacttctctgcccccagccttcctcactgtctctctggcaggcagcagggtctgccccagcccctgctaacagcctctcttctgttcctgcaggacccccaaagtggttgacatccccacttacgaggaagccgtgagcttcccagtggccgaggggcccccaacaccacctgcataccctacggaggaagccctggagccaagtggatcgagggatgccctgctcagcacccagcccgcctggcctccacccagctatgagagcatcagccttgctcttgatgccgtttctgcggagacgacaccgagtgccacacgctcctgctcaggcctggttcagactgcacggggaggaagttaaaggctcctagcaggtcctgaatccagagacaaaaatgccgtgccttctccagagtcttatgcagtgcctgggacacagtaggcactcagcaaacgttcgttgttgaaggctgttctatttatctattgctgtataacaaaccaccccagaatttagtggcttaaaataaatcccattttattatgtc

SEQ ID NO: 13125 - DNA, 263 bp, Homo sapiens
tcacgcctgtaatcccagcactttgggaggccgaggcgggtggatcatgaagtcaggagttcaagaccagcctggccaagacggtgaaaccccgtctctactaaaaatacaaaaattagctgggtgtggtggcgggcgctgtaatctcagctcctcaggaggctgaggcagagaattgcttgaacccgggaggtggaggttgcagtgagccgagatcgcaccactgtactccagcctgggtgacagagcgagactccttctca

SEQ ID NO: 13126 - DNA, 12259 bp, Homo sapiens
  misc_feature (398)..(398): n equals a,t,g, or c
ggggagtgttgttaaccggaggccagccgcagtcgccggattgagcggctgcggcgctgggttctggtgagtgggcgaagtctggcccgagttgtggttggagtcgggacccgaaccttccccttgaggtctccggagtcgcacgcccctcagccccgccgacacgctttcggcctgtcagctggccggagacctcagacgccggtggcgcgctttgctcaagcctgggccctgctgcgacgcccgcaactcctggtgctcacaggtgcgcggccgcgagggcgacccggctcctcccgtcccgctgctgctctctcccgtcccgctgtttttgtggtgctctgagttgacactactccggggagtcgggggaccccaggattccaggctgacgtttntacgccgctcgcagggcgggcgtccgaactgcccaccctaacacagctgtcgatccggctgtcgcctgcccagcctgctatcctctgtgccttggctgctctcagccctgcgtgcgcattcccgcccctggagcagatttctgctgttgcctcccaccccatcttctccaccggagggtcagcggtgcagctccccctcctccaacattgcagcttttcctcatcacctccctagaggaggcggcttggcaggcagcgtggaaagagccctagatttgaagcaagactgacccaggttccaggccttgcgtcagtgtgatcacttaaccccttcgagtctaatttgtaaaatggggtagcgtaagctattctttgtctgatgatttcgagggcgaaatgtgatttcccccccactttctcctatgaattgaggctgtgccaggcaccgggctattttgcacagcacgagcatcacataagttattttcttgccccatgcaggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtgagttcagggctcagggagggaggaactccctgggagggaaggaggagtctgcctgggcaaggggcggggctagaggtcaggtaagtagggaagtagccgccagctgcctaactttgaataaactgtgatgaggatgtggaggatcctgcatgatgagtcccaaggagaggaaagcagaaagtgacctcaaaccacagcctctccccactcctaggtcctgtacatccaggcctttgtccttgtcttccttctgggcaaggtgatgggcaaggtgttctttgggcaactgagggcagcagagatggaggtaagatgtcggctgccccaaaggtgagggcagggtgctgggaaagaatgtttggtatccacattattccctgcctggcccccagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttgtgagtcaaggcagggagttctggagcaggtggaagccagggagtagccagcgggcaggcttaaggagcagggagggctaggttgagggtgtggggtgagccccaggcctcctgacaggcctcttctgtgctctgcctcagatggaacgcagccccaacatctcctggctctttcactgccgcattgtctgtgagtgagattcaggggaggggaagggaggactggaacgtgaaccgtggacctgtactccagagcacaggctaccccccacagctgtacaggaaagataatttaggaagttaatttgcatagtctctgtgctgttccactctagggcttctcaactgcctgggccctcagccctttgccttctcacctgcagcctgggcagccccaacaactccccctcccccaggaagttcccagagggccaggttcagtggagtgtgcccacctgactagatcgctggggccatggtgggcttgagggtggggctgtcctagagcattaaacagctgttgggccctgggctgacccccccaccctgcatgtgtgggggtccccacagctcttatgttcctcctgggcatcctggacttcctcttcgtcagccacgcctatcacagcatcctgacccgtggggcctctgtgcagctggtgtttggctttgaggtaaaactggcttgggaggttgagaggacaagcccgaggtgaccccacatgtgccttgaataacccaacagacccttcctcagcacctgctatgtggccaacctgtgctggccaccaaggggcagtgatcagatatggctcctgccctccacacgctcactcctaggtgactggggagacgcacaaagaggctaggacagaggaggagccccaacctggggctcaggagagggttcctggaggctcgtgccggagctagctggtaatggacaggagaggattagttccatggacaactggaggcgtgtccctggcagagagagaatgtgttcagtgacaacagctcatatttgttgagtgcgaatttcacaccaggccctatgctgagctcctgacctgcatctcttattcagcaagacaatactgttataaaggaacagttaattatgtcattttatagataagtaaactgaggttcactgagttgccaaaagtcacagctagtaagtggaggggctaggaggaccctgggtgtgtctagagcctgtgattgtaccactgcacctgctgtgcagaggccttggggagcaatgtgggtgcagcaagggggagctatgtgtttacatccccctcgtccccctctcccttcagtatgccatcctgatgacgatggtgctcaccatcttcatcaagtatgtgctgcactccgtggacctccagagtgagaacccctgggacaacaaggctgtgtacatgctctacacagagctgtttacaggtgagaggggcctgggcctctcctgatctggaccagcatcctccactctgcctcctggccctgtgacctgctgctttctgcatcccctcccctcaggcttcatcaaggttctgctgtacatggccttcatgaccatcatgatcaaggtgcacaccttcccactctttgccatccggcccatgtacctggccatgaggtgagcccggccctgtcccccgatcctcctgacctgatcccgtcccttctcctgctttcactgactgtcctttcagacagttcaagaaagctgtgacagatgccatcatgtctcgccgagccatccgcaacatgaacaccctgtaagtaggcttgtcatggctgctgtcccaagctcggtcctgggtccctctgcttccagctctggacctgatacagcccctgtcatcctaaccaggtatccagatgccaccccagaggagctccaggcaatggacaatgtctgcatcatctgccgagaagagatggtgactggtgccaagagactgccctgcaaccacattttccataccaggtgggaggggccctggggagcctgcacagcaggcacaggccccagaaggcaggcccctagggacctgctgacctctgcctggccttgacccgcagctgcctgcgctcctggttccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaactgtgagtatccccttgtctggccacccggcataccactggatacttgccctgggctggatgtggaagatgctgggaaattggagagtccctgccctccagaatctcagtctgggccagggagggattaaaagatgagaaatagatgcttgcagtcagtgtgaccagtgctgggctgagggcctgtgggaataggacagagctctcaatagccaggccccctgcctgggagttgggtctgtgtccatttggccctttccttacctccgtcttctctctgcagtcccccagggcctcctgcctccttttcctccaggcatgttcccactgtggccccccatgggcccctttccacctgtcccgcctccccccagctcaggagaggctgtggctcctccatccaccagtgcaggtgagcctttgggtactgtgacagccagggggcggcagggatggaacactcactgacttcgttcctgctcttcagcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttggtaagctgggccactctctgggttcttcttgggggtgaggttggtgtctggccccagcagcccagactgagcctctctctctccagccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggtgtgtctgtacaggggaagcagagtgggtttggtgggtcaggagtggagctgccaagaggtccccagcagtggttcttggcctttgacacctgccaattcaggctgcctatctacaggcccaccaagggtctccaggagttcttggtaactcctggtgcctttatttcccactccagaaagcatgtctggatctaagtaggagtgatgtttattcgagagctgactttagatcttattcctttatatttttctaaagtcaaattattcagaatttgcagtgctttagttcatcacatgatattcttctgagatgtggtgacacttagattggcaattgctgcccccaaactgagggagcgaataataggaagtcacttggagccatcctggctcaagttcaagcgctggtcccatcactcatttttgacctctcattatttgaataaaggggtcttaattcatattcataagtgatgtgtactgccagatacacacctataatcagcactttggaaggctgaggcaggaggattgtttgagcctaggaatttgagggtgcagtgagctatgattgtgccactaaattccagctttggtgacagagccgagacgctgtcttttaaaaaagtgacatgtacataatgcctggcatctagcagtgacagcacaggcttggagaggaacttgagtccaaggctcgagcactgtggcttattgagtgagtcccctataaggtgcctgactccccagggtggagactgcagggtaagagtgaacaggtcaacagtccctgcctgcaagcaccttacagctaagggatagaatcatttggcccttgagtccagtcaccctgtctgagttcattcagcatgttcacttgtgtttgccaggcactggggccacaagggcacatcattctatactctgttctgcaaggctcaccaagggcaggagaatctgcccaaccttggatgccaaggccaggcccgcctctcgtcccttctcttcccaggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccaggtaggtgtgattggcctccagccgggggagcagggaacttctctaggttccacttccagtctctctgtccccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcctctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaacaattggtggggtttgtgtcacagaatcgatcaaatcagtgtcgggctccttgctgtggctgtacacttgaaaatggaatggaatctccaggagtgagggtttccatggaagccagcactatccttggggacaccactgaccattaacagattaggaagatgtgcccattttacacacagagaagcagcccagagttcagtgccctgcttcagggcagagaccaagttggggagtcaggaactgaaagctgtcttagccagtttgggggcagggtggggtctcaggcctttggcccctgtgactccaagtataaggcatatatgaaggctagtgagctggggttgggatgggatggcagggtgaaaggtcagcatattcctgcctgcaaacccctccccagccttgattgcaggtcagaaggctgcagggggatgtccctatgctggctgtgagttcccagccactcccttgtggtcaggccagcaagtctggtctgcaatggaacagtgaccaagaacgtgcctcctacctctctatcagagcccggggctaacgtgggcactctgtgccccagtgccagcactgtactttgaacagaagatctccaagacccatgcccgagtcatctgtgttctccatcacctgcaccaaacaagatctggcctagagcaaaggcttgggggtatttgcaacagtgagcttcggagggccaaggaaacaaagtgcccagtggctctgccctgtgctaccttcccctaaactggggttgggctactgcttccaccaaataacaactagaatttgaattgctgagcccaaggaaagaaaaacaaaacaggccaaggtggaccaggcacatggctcatgcctataatcccaacgctttgggaggccaaggtgggcggatcacttcgagtcaggagtttgagaccagcctggccaacatggtgaaaccccatctctactaaaaatacaaaaattagcaggctgtggtggtgggcgcctgtaatcccagctactcaagaggctgaggcaggagaatcccttgatcccagaggtggaagttgcagtgagccaagatcatgccactgcactccaccctgggcaacagagtgagactccgtctcaaaaaacaaaaaagaacaggccaagataggagggagagaaagctgctgacgccccccattagcctggtgatccctatttggtctcccacattaggcactctcccccagcatgtacatagagttgttttctcctttatgcaagcaaggcctgaccccaaagtcctttagccctagtttctgtatcccctgtctcaggggctccaacacccacctccctcctcctgaggccccctagacttgatccacagggcatgctgacaagcaggctgctcggctgggcctcagaagcctttctccaagagccaggctttaagctcctggtcaaagtagcccttgatccgtagggtacctgtcacctcattgacctgggtgacaggtgtcttccccagcagcgggctcagaaaatcttccacgtctttctgcagggcctggggaaagatgacaaatcaggtcaggccaagagtcccttcccttaaaaagactcctgtcccttcagccctgaaagggtcaggcccagtcccagacccacccacccacttacccagatgtccccttccactttccggatcacagtcatctgccggttgccatgcgtgatgtccttgtagacggggatgttgtgcatccgagagcgtcgtacaaagtaaggcaggttgggtggggggtctgcaacagggaaagacactgttaaatcaactcttcctacgtgccatcccacctcagccaaggcccttgctctcagtctgcagagggccagtgcacccagctggaccaagccacctccagactttaggtcagggggtctcctctttccttcagcttggagtcaggaccaaattgttcaccctggtaccctaaggccccacacagggcctggcactaagtaggtgctcaagaaaaaatgaaatcagggacatgcctccctggatctttgggtccccctctaggccaacccttgccctcctccactgggtcagggaggccgaaatcaatctctggaacaaagagattgggatttgcaagcactgagcacctaccatatgctgggctctgcactaagggctctatgtactgagcagattatctccattttgctaaaacaggttgggtcaagctaagtgactaattcaagataacatcaacagtaaataaagccaaattcaaacccagaactgcctgactccaagctgtgttcttaattacagtacatagtctgctggggggaaagaaggtccaagctcttgggttttctctctgttgtttactttcccccatatggggaagacctgatctcaatagtgtggatggatgagtaccagtgaacaacagaaggctccactcctcggctcttccttgggcatgagacagatgtaacccagagggattgcaaaatgagtcctgaacccactggagagtccagagcctcatgggggaggccaacctctggggaggaggtgatgctccgtgaagctttcaaatcatccctaaccacccagctcacctctgggaggctgccagccactaggggtaggataatgttcatgctttgggggatctgggatcctggtagccggtaacaggcgctccacaaactgatattcatccacagactccacaaacctggggtaatctggagggccctgggtctggctctgaagcaaaacaaaaatcccatttctccattagcctacccaacacaggatggcataacttcagtaagtagagaatggaaacattacaggcagagagaatgacataaataaaaggctgggcgacggtgtgaaagctatcagaatcaaaatggagtgagtcacttgggttaaaaatcccaacaaatagagctagggagggccacgaagagagagttcttgggcacaaatacttaataacaagaactaccacaaaagactgcaaaaaccacagccttgcacaaaggccacttcaaccttacacaaaaaaatatttctggctgggcaaggtggctcacgcctgtaatcccagcaccttggaggctgaggcaggaggatcatctaaggtcaggagttcaacaccagcctggccaacatggcgaaaccccatctctactgaaaatacaaaaattagccgggcatggtggtgcatgcctgtaatcccagctacttgggaggctgaggcaggagaattgcttgaacccaggaggtggaggttgcagtgagctaagatcgcaccattgcactccagcctcggtgacagagcgacgagactctctcaaacaaaacaaaagaaaacaaattcctgcatggccatctgtccaacaactgcctgtccaatcttgaactggcaccacccatgttattcatccttgtagccaaggataactgtctcaaaacaattatgtaatactcatttttcctttcctttatttatttttattatttttttagatagagtctcactctgtcacctaggctggagtgcagtggtgtgatctcggctcactgcaacctccgcctcccaagttcaagcaagtctcctacctcagcctcccaagtagctgggactacaggcacacgccatcacacccggctaatttttgtattttttctagagacgggtttcaccatgttggccaggcttgtctcaaactcctgactccaggtgatctacgcgccttggcctcccaaagtgctgggattacaggcgtgagccaccgtgcctggcccatttttctgttaaaaacctttgtcttcttttacctccctgataagcacatagtctatacccattcccgaataaatatccttttcttttagagtctgttatttaggttgacataagatagcaccagtctttggttttccatggtgcagggtacagatgggatggaaaggaggctcaggtactctgaatggtctgcctctcaggatttctgtgggatgcaaaagagtatatgtacacttctgaaaagtcaatcaagcctttagaaacttaaggcttaactttctgtctcggttttagaaatagatattattatattggcagcgtggccttgtttgtacctccatgattgcctggctggccttgctaacctaatcacatctgtgacgggatatagtgatgtttaatcttatgattgccttaagaattaaggcaatcagacgggttcggcggctcatgcctgtaatcccagcactttgggaggccgaggcgggcggatcacgaggtcagaagatccagtccatcctggctaacaaggtgaaaccccgtctctactaaaaatacaaaaaattagccgggcatggtggcgggacgtgtagtcccagctactcgggaggctgaggcaggaggatggcgtgaatctgggaggcggcattgcagtgggccgagatcgcgccactgccctccagcctgggcgacagagcgagactccgtctcaaaaaaaaaaaaaaaaagaattaaggcaatcataattccccacgcacactcatatgctaggaccccgccccttacctgaaacgttgtggcttatatagacactgccaggcactgtgttaagtgctcccaaagagcaccccagtctaccattttccctctcgattctatatgtacactcgggacaagttctcctgatcgaaaacggcaaaactaaggccccaagtaggaatgccttagttttcggggttaacaatgattaacactgagcctcacacccacgcgatgccctcagctcctcgctcagcgctctcaccaacagccgtagcccgcagccccgctggacaccggttctccatccccgcagcgtagcccggaacatggtagctgccatctttacctgctacgccagccttctgtgcgcgcaactgtctggtcccgccccgtcctgcgcgagctgcctgcccaggcaggttcgccggtgc

SEQ ID NO: 13127 - DNA, 1585 bp, Homo sapiens
agcagtgacgtgacacgcagcccacggtctgtactgacgcgccctcgcttcttcctctttctcgactccatcttcgcggtagctgggaccgccgttcaggtaagaatggggccttggctggatccgaagggcttgtagcaggttggctgcggggtcagaaggcgcggggggaaccgaagaacggggcctgctccgtggccctgctccagtccctatccgaactccttgggaggcctggccttccccacgtgagccgccgcgaccaccatcccgtcgcgatcgtttctggaccgctttccactcccaaatctcctttatcccagagcatttcttggcttctcttacaagccgtcttttctttactcagtcgccaatatgcagctctttgtccgcgcccaggagctacacaccttcgaggtgaccggccaggaaacggtcgcccagatcaaggtaaggctgcttggtgcgccctgggttccattttcttgtgctcttcactctcgcggcccgagggaacgcttacgagccttatctttccctgtaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtgagtgagagaggaatgttctttgaagtaccggtaagcgtctagtgagtgtggggtgcatagtcctgacagctgagtgtcacacctatggtaatagagtacttctcactgtcttcagttcagagtgattcttcctgtttacatccctcatgttgaacacagacgtccatgggagactgagccagagtgtagttgtatttcagtcacatcacgagatcctagtctggttatcagcttccacactaaaattaggtcagaccagggcccccaaagtgctctataaaattagaagctggaagatcctgaaatgaaacttaagatttcaaggtcaaatatctgcaactttgttctcattacctattgggcgcagcttctctttaaaggcttgaattgagaaaagaggggttctgctgggtggcaccttcttgctcttacctgctggtgccttcctttcccactacaggtaaagtccatggttccctggcccgtgctggaaaagtgagaggtcagactcctaaggtgagtgagagtattagtggtcatggtgttaggactttttttcctttcacagctaaaccaagtccctgggctcttactcggtttgccttctccctccctggagatgagcctgagggaagggatgctaggtgtggaagacaggaaccagggcctgattaaccttcccttctccaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcatcgcattgtttcatctttacttgcaa

SEQ ID NO: 13128 - DNA, 7047 bp, Homo sapiens
gaagagagggacaacttcctccagcagctttataagtttatggaagacagaggtattttcatgctcattattttaaagtagtcatttctttttcatgtttacattctaggtatatgcattgtttttgttagtattgcagataaacagttttggattttatttatttatttattttgaggcaggttcttgctttgatgcccaggctggagtgcagtgatttgctcctggcttactgcagccttgacctcctgggctcaagtgatcctcctgcctcagcctctcgagtagctgggactacaggcacgtgccaccatacccagctaattttttatttttctattttttgtagagacgggttttgccatattgccgaggctggtctcaaactcctggcctcaagtgatcctcttacctctgcctcccaaagtgctgagattacagctgtgaaccatcatgactgtctagttttggattttaaataaatcctagaatcagttacacctgacagtagtaaaatatttggaattaaactgttcatacctattttacatagaaacaagtgagaaaatattttgatacaatttagttttccctgtcacttacaaagctaaagaatattctgatatttcagaaatagaaagtgaccagttatgttaatctgcatacccactaattactaatgctatatttgtggcaaataaactagataaactagcctgatccttgttctcagcaaattaaacataataggagaccaatcgttatctgaaaaagatgagatttctaatataggtagaataatagaacaattataaaccatcatactccttgccatttgttagtcctagaaaatcttaagataaattggtcctaaacattctgtgtggccttcagaaatcatccttcagattactgctaacagtcttaacatttgtgtcaaagtagtgaaagtggaaccagggtataaatcttatcttttctgttgtgtttgtttatgcctaaactttttttttttttttttttttttttttttgtgacagagtcttactctgtcactcaagctggagtgcggtggcgtgaacatggctccctccagcctccacttcctgggcttaagcagtcctcccacctcaggctcccaagtacctgggaccacaggtgcacaccaccacactcagctaatgttttccttttaatttttgtagagacaggatatcaccatgttgcccaggctggtctcaaactcctgagcccaagtgatcttcctgccttagcctcccaaagtgctggggttacaggtgtgagccactgcacccagccctatgcccaagcgtcttgaaccagcaacattgttggccacaccatgcagtgtttactttagttttactcaattcattggcagttaaagaggtagctttattagtataacacctaaaatctgaagatccccacaaagctatataaataagagagaattattatatatattattatatataaaacatataaaaaagaattattatatataaaacaacacaagagaattatcttgtgttgttttacattgtttaaggctctttaaatatgtgcctctaattaatgaaattggggaaattagaaattgaccgctttgttttcaaattagtatttctcatttgaataaacattttatttctacctacttacattgaaaaggtactccaatcaacaaaccacctgttttgggctataaagatctcaatctcttcaaactcttcagactggtttatcatcagggtggatgtgacaatgtaagtataacattgctttttgaaacatgtattgatgtggtaaaaagttaagttatcttatattgcattattatatgcacattggataataaatacattttcttaatgaacatagaatattaggataaagatcttttcctggccaggcacggtggctcacgcctgtaatcccagcattttgggagattgaggcgggtggattgcttaagctcaggaattcaagactagcctgggcaacatggcgaaaccccatctctacagaaaatacaaaaattagccaggcatggtgtcgcatgcctgtggtcccaactactcgggaagctgaggtgggaggatcacttgagcccaggaggtcgaggctgcagtgagccctgattgcaccactgctctccagcctgggcgacagagtgagaccctgtctcaaaaaaaaaaaaaaaaaaaaaaaaaaaaaaaaaaaaaaagattaattccctttgcaaatgttaacataaaaacttaattttccagattgatagtggtgctgtatggaagcaaatttatatggaccttggcattcctattttgaattcagctgcttcctacaatgtaaaaactgcttatagaaagtaagtagtatagtttattcatcaaagaatatatatttataggaaatattttccatttactttgttaacaagaatacatcaatctagaaacattaaagttagagaaagtatataaaaaggtttaggttgacagatacttgtgattgaaagttatttcagcgcatctaatctgctttactccatttcttatgttgtcctgatttcctttccaaaatcaggatgcaggtagtgtctgcgattatgatacatattacagagctacatcttttggggtgaacagccttcatatcaaaacttatgatagttatgtttagctatcacaagctcagacgtctcaggacggcattttatgatcagtttttctgtttatgattctatctaaaacaccaagaaaatagtaacacagaaaagagtaacaaaaatttttttaaattactgggctttactttttaaaaatgtgtttaataacatgaattcaagttagatgcaaagactgtaagatttcttaaatgaaatattgtttgtttaggtatctctatggttttgaggagtactgccgttcggcaaatattcagttcagaactgttcatcaccatgaaccaaaagtaaaagaggaaaaaaaagacttagaagaatcaatggaagaggctctcaaattagatcaagaaatgcctttaacagaagtgaagagtgaacctgaggaaaatatcgattcaaacagtgaaagtgaaagagaagagatagaattaaaatctccgagggtgagttcttaatactagttttatctggtttaagtattatttaaaattttttattatagccattttcatatatacacaaaagtactacagtgaacctagtttattttccagtatttaatgctgcttagctagctacttttttcgaaatatattgtatattatttcctctacctgaaaacccttccttctgttttctgtttatattcgattaagtcattcttgtctgggatgaatcccagatattccttttccagtcttctgctaaagtatcacctcattgaaggctgtcttggtcaccttatctgaaattgtaacctgcctcctctctttggaactctcagtccctctgatgttgttctttctgtaatttacttatttattctgtttattgtgattatctattttgccccactctacactagaatcacactccacgaggtcagggattagtgtttatttcgtttattgacagatgccaggcatttagaatagtgcctggcacataataaaggcttattaaatagatgttgaataaatgaatcacctctttatagtgcctgtgccctaaactagatgatatcttgtctttgtaactttatagcacactgtgtagctctagtgatgcgtacatgtatgctggttgtatcttccaactttgctccttctttcctttaatatataaggtctatttaggaattgtcatctagcatttggatcagtgtccagtgatgttacatagtaggatttatcaaattttagaaagagaaaggaatttaccacactatcaaagaagtttaattactatgtcttattttttggtggaatcatatttaatgaaagagaatgtgaaattgctttgtcttatagttcagaaaccagttttcaaaacttccttcatgtagtaaatggaatcttctagtgaatgtcatgaaatttccaaattgtttttttttaattttttttaaaattgtggtaagtacatataacataaaatttgccaccttaactctttttaagtgtacacttcattggcattaagtacattctcaccgttgcataagtgtcaccaccgtccagttccagaatatttttaccttgcaaacctgaaattctgtacccattaaacagtaactcctcattcctccccaacccttagcaatcaaagttttactttctgtacctatgaatttgatattctaggtacttttatataagtgaaatcatacagtgtttgtcctttttcactggcttattcactcaccataatgtctgtaagacattatgttgtagcacatatcagaatttccttcctttttaaaggtgaataatattttattgtatgtattgtggacatactttcttttcattacctaaaaaccttcctcatcctacataaaatatctgcagtgtgctgtctagtatggatgaaccataaatctaccttctccaagattttctcccagttttttactattttaaaaagtgctgccgggcgcggtggctcatgcctgtaatcccagcactttgggaggccaaggcaggtggatctcgagatcaggagatcgagaccagcctcgccaatatggtgaaaccccatctctactaaaaatacaaaaaaaaaaaaaagtgctataatacatttgcttgtaaaaatatcctcatcacttatccacatatataagccaggcttctaaaaatggcatttctcacctgtagtcccagctactcaggacgctgaggcaggagaagtgcttgaacccaggaggcagaggttgcagcaagctgagatcgcaccactgcactctagcctggtcgatagagcgagactccatctcaaaaaaatgaataaataaataaaaacagtatttctgggacaaaggtatacagacccaaattttatagcagttgttttcattcatttacctatagatattttaaaagcacctgctaggccgggcacggtggctcacgcctgtaatctcagcactttggtaggccgaggcgggcggatcacgaggtcaagagatcaagaccatcctggccaacgtggtgaaaccctgtctctactaaaaatacaaaaattagctgggcatggtggtgcgcgcctgtagtcccagctactcaggaggctgagaatcgcttgaacctgggaggtagaggttgcagtgagctgagatcacaccactgctctccagcctggcaacagagcgagactctgtcttaaaaaaaaaaaaaaaaaaaaaaaaagcacctgccacctgctatgtgccagccactgtgtagatctgaggagatggaagtgccatcttggaacttgtgtgttagtgctttaagatagaaagaaattaatttcttctttttctgcctttgaagtgtaaatagcacatagccagcaactagggaaaacatttgtttactgagatattaattgtatcctaatgcttcctaagttgctggctctttatctgctttattccaagaagaggagacttctgccagtgtatagaagttgacttgaaggagaacctaggagatagtgaaattgctcaccagtcatggtcatttcagcattcagtgggctagatagaagctagtggtggtaaaacatattgctgttggcccagcgagctctccagatactcattcaaagaagtctgctcacttttttgccattgatgcaattcagtcctttaaaaatgtaatcatccacaaatacagtgacaatgtaaattttgtcttactaacggtagaattagagaccacagagcctttaaagaagcaaaattcaggggattggttttattattgttacgttttatcattaacattagataatttattttaaatttttattatagtcgagaaataataaaagtgagataaaatgatgtagtaaacaaaggagaaaatttttatttcttttttgttgttgttgtttacttttttcattcaaacagattctgacagatatttcttaggtagtatatagccaaagtagacctggacataattaagtaattctatcagttattcttttactttcaaaaggaagagaaaggtacctttgagttggttttcagggccacgtttcaagccagagacattgctatgaaggttaaaggaaaagatattttttcctgcttttttcccctttatagtgatagctattttaaagcttttatcccctctactagggacgaaggagaattgctcgagatgtaaattctattaaaaaggaaattgaagaagagaaaacagaagacaaattaaaagataatgatacagaaaataaggatgtagatgatgactatgaaactgcagagaaaaaagaaaatgagctactactggggagaaaaaatacaccaaagcaaaaagagaagaaaattaaaaaacaggaggattctgacaaagactcagatgaagaggaagagaaaagccaagagaggtacattatcttatgtttgttctccagaagcacctgtctggggtacaacagcgctttgttcctgcttagagattcaggtttgagggaatgttttcttattgggacttccgttcctcttgtctaatgaaggtgagacacattgtgaagatgatgtgtattgcctttcggaattggagaatatactggtcgcaccattttaatagcacttgtgccctaaacagtggcctcaaagaaggctgcgccacccagtcaaaagaaaggtcctgcagttgacagcagggaagggagctggagaaaaatggaggaagtggacaagaggaaacagcgacagcaaaaattccattttaaaaaaggtacaatgtgggaaagctaacaaacacatgggtgcacagtactagagatgtttctgtgtgttagctttaagacatttttctttttcaagttat

SEQ ID NO: 13129 - DNA, 1941 bp, Homo sapiens
gtcaccttatctgaaattgtaacctgcctcctctctttggaactctcagtccctctgatgttgttctttctgtaatttacttatttattctgtttattgtgattatctattttgccccactctacactagaatcacactccacgaggtcagggattagtgtttatttcgtttattgacagatgccacgcatttagaatagtgcctggcacataataaaggcttattaaatagatgttgaataaatgaatcacctctttatagtgcctgtgccctaaactagatgatatcttgtctttgtaactttatagcacactgtgtagctctagtgatgcgtacatgtatgctggttgtatcttccaactttgctccttctttcctttaatatataaggtctatttaggaattgtcatctagcatttggatcagtgtccagtgatgttacatagtaggatttatcaaattttagaaagagaaaggaatttaccacactatcaaagaagtttaattactatgtcttattttttggtggaatcatatttaatgaaagagaatgtgaaattgctttgtcttatagttcagaaaccagttttcaaaacttccttcatgtagtaaatggaatcttctagtgaatgtcatgaaatttccaaattgtttttttttaattttttttaaaattgtggtaagtacatataacataaaatttgccaccttaactctttttaagtgtacacttcattggcattaagtacattctcaccgttgcataagtgtcaccaccgtccagttccagaatatttttaccttgcaaacctgaaattctgtacccattaaacagtaactcctcattcctccccaacccttagcaatcaaagttttactttctgtacctatgaatttgatattctaggtacttttatataagtgaaatcatacagtgtttgtccttttttactggcttattcactcaccataatgtctgtaagacattatgttgtagcacatatcagaatttccttcctttttaaaggtgaataatattttattgtatgtattgtggacatactttcttttcattacctaaaaaccttcctcatcctacataaaatatctgcagtgtgctgtctagtatggatgaaccataaatctaccttctccaagattttctcccagttttttactattttaaaaagtgctgccgggcgcggtggctcatgcctgtaatcccagcactttgggaggccaaggcaggtggatctcgagatcaggagatcgagaccagcctcgccaatatggtgaaaccccatctctactaaaaatacaaaaaaaaaaaaaagtgctataatacatttgcttgtaaaaatatcctcatcacttatccacatatataagccaggcttctaaaaatggcatttctcacctgtagtcccagctactcaggacgctgaggcaggagaagtgcttgaacccaggaggcagaggttgcagcaagctgagatcgcaccactgcactctagcctggtcgatagagcgagactccatctcaaaaaaatgaataaataaataaaaacagtatttctgggacaaaggtatacagacccaaattttatagcagttgttttcattcatttacctatagatattttaaaagcacctgctaggccgggcacggtggctcacgcctgtaatctcagcactttggtaggccgaggcgggcggatcacgaggtcaagagatcaagaccatcctggccaacgtggtgaaaccctgtctctactaaaaatacaaaaattagctgggcatggtggtgcgcgcctgtagtcccagctactcaggaggctgagaatcgcttgaacctgggaggtagaggttgcagtgagctgagatcacaccactgctctccagcctggcaacagagcgagactctgtcttaaaaaaaaaaa

SEQ ID NO: 13130 - DNA, 447 bp, Homo sapiens
gattatgtggcatgcacccctgattctagtttggaaaatacattcttgccccacatcacaccaataaatttcagattttttaatgtccatcctgtttgctgttgagtaaaactgtattttttttctgtgtattagacaagtatggactgaactgacttaaaaatagtcaaatattaggcagtccagcaagatcaaggtagtctctgaccaagttattagctgcttctgtaagtgttgtcaaatggatttactaattttaggacacgactaaaaatgaattttaaatgagcaacaacataacatacttacttgtaataccagctctcttccatagttatttttctattattatgtgatattaaattttctagaaatttgagttgttaagccaaatttgggaaaactgacctgccattgagagaataaatatttggaaaaataggatga

SEQ ID NO: 13131 - DNA, 1699 bp, Homo sapiens
tacttacattgaaaaggtactccaatcaacaaaccacctgttttgggctataaagatctcaatctcttcaaactcttcagactggtttatcatcagggtggatgtgacaatgtaagtataacattgctttttgaaacatgtattgatgtggtaaaaagttaagttatcttatattgcattattatatgcacattggataataaatacattttcttaatgaacatagaatattaggataaagatcttttcctggccaggcacggtggctcacgcctgtaatcccagcattttgggagattgaggcgggtggattgcttaagctcaggaattcaagactagcctgggcaacatggcgaaaccccatctctacagaaaatacaaaaattagccaggcatggtgtcgcatgcctgtggtcccaactactcgggaagctgaggtgggaggatcacttgagcccaggaggtcgaggctgcagtgagccctgattgcaccactgctctccagcctgggcgacagagtgagaccctgtctcaaaaaaaaaaaaaaaaaaaaaaaaaaaaaaaaaaaaaaaaaaaaaagattaattccctttgcaaatgttaacataaaaacttaattttccagattgatagtggtgctgtatggaagcaaatttatatggaccttggcattcctattttgaattcagctgcttcctacaatgtaaaaactgcttatagaaagtaagtagtatagtttattcatcaaagaatatatatttataggaaatattttccatttactttgttaacaagaatacatcaatctagaaacattaaagttagagaaagtatataaaaaggtttaggttgacagatacttgtgattgaaagttatttcagcgcatctaatctgctttactccatttcttatgttgtcctgatttcctttccaaaatcaggatgcaggtagtgtctgcgattatgatacatattacagagctacatcttttggggtgaacagccttcatatcaaaacttatgatagttatgtttagctatcacaagctcagacgtctcaggacggcattttatgatcagtttttctgtttatgattctatctaaaacaccaagaaaatagtaacacagaaaagagtaacaaaaatttttttaaattactgggctttactttttaaaaatgtgtttaataacatgaattcaagttagatgcaaagactgtaagatttcttaaatgaaatattgtttgtttaggtatctctatggttttgaggagtactgccgttcggcaaatattcagttcagaactgttcatcaccatgaaccaaaagtaaaagaggaaaaaaaagacttagaagaatcaatggaagaggctctcaaattagatcaagaaatgcctttaacagaagtgaagagtgaacctgaggaaaatatcgattcaaacagtgaaagtgaaagagaagagatagaattaaaatctccgagggtgagttcttaatactagttttatctggtttaagtattatttaaaattttttattatagccattttcatatatacacaaaagtactacagtgaacctagtttattttccagtatttaatgctgcttagctagctacttttttcgaaatatattgtatattatttcctctacctgaaaacccttccttctgttttctgtttatattcgatcaagtc

SEQ ID NO: 13132 - DNA, 4133 bp, Homo sapiens
ctcaacctcaggaagtcagtccctgggagccatgaagtgcagcaatgacaggcccatctggagaagacatgacggctgggtctgcaggacccagctgaactcaggagcagatttggggatggcaatcaggtaatgtcggattctgtctcccctgccttctcacatccagtaggtcactaagcctagtcctgtcttctatatatatatttctggtctagactcttcatcctcactgtagttactgaacttcaggctgccatcacctctctctcgactgtgggaagagattatggttacctaactgatttctttctgctctccttcctcttgtctattctgccctctcctgcccacataacctttctcaaatataagtctcatcatgacttttcttggtttatatactacctactaaataatcaaaacatcttagtagagaatataaggcccctgtcaatctctccttccagaaaggtaactatggaggctaacacagcactatgttgacttctgcttaaccctggctacaggaatgcctctgaaatttccagtttaagtattgttccttgtgtaagagcacaaacttactgtaaatcctgcccttacataaaatcatccttgataaacttgtactgacttaaatcctgcccttagatcaaattcctacccattccctctgaagcacgtgtaccctttccctatggtatataatccctggtctgaggggtaatggtgcagccacccaagaccatacttctgtccataagttccccagtaaaatcaccctccaatggcacactggacttctttgtcgctcagctccttctgcatttgggagccactttgtgtacatggccctttcaccaaacagtaacacttcctcaataatggccaacacttattaaacatttaccatgtgcccaataccatgcttagtgcttaacgaagatgatctcatttgatcctgaaaactaccttttgaaccagccaagcattatgatccgtatgctgtagaaggtggaattggagctcagagaagcaaaatgacaaaggtgacaaagctgcagcagagctggggtttcaaccctggcagtccaattccaggcccctgctcttcccaccagggacttcctgcagccttctgaacctattacgcattttcctgcctctgtgtctgcagatgctgttcttctacctcaaatgccttgatccttattctcttcacctggacagttcttcttcatcatccaagatccagctccttcctgccttctttaagaagccttcatggacctctcccctgggttatgccatcatagccactccatgcaattctctctcatagcacttatcttgctacattgaactgtctgtctctctaacagagtgtgagcccgccttgaaggtaggtaccctagcctttaccttgacatccccatattcctagcagagtggccaacacgtaataggtgtgcaatatttgtgggtttaaagacatcagccgctggataaagactgaggctctgtcttccggatcaagtaactgggctacaatgcctaggcagatctccatctgttaaatcagattagcagtctgcccagttcctcaggtgttgaaattttagaaactctccccccaggactctaacaggaatccagagttgagaaccactgctttcataaaagcagattttgtggaggcaagggctgccagggtagaagcttgctaaggaaaattacacaacatgtttatacctgcgaaatctgtgtaaaataaacaccagaaagcaactaaaggagataaacttccaaagcatgggagaaaataccaacccaaagttatagtttaggaagacacatgacattgacagtcattaataaaatgcaaagtaactctaaggtatcgttgcacaactgtgagatgggcagaaatatgtaataatgataaaaggctgccaggattatggcgaaaattgttcccttaaaaactgctgttagcattacactttgattaattctactctgttttgagacaataatctgcaactgtgtaaccaaagctcgagaagtctttgttctatttttagaatatactataagaaaataaagaagaatgcagtttattcaaaattgcctgtagcagtggcatgacataaaagtgaaaaattagaagccatctaaatactgaattttgaagactagttgaagtaaattatggatcacaaagtaaattctggagcataataaaacactatgctaccattacaaatgacgaatatccaacatttctcacacatggagatgtgtatgaaacaagaaaaaggctaaaaaaaaatcccccatgctttgtgccctgcgatgagtcacataacagcaaatcaatacaaattcacaaagactggaggtgcattcgatgggcaaaaaaggtactgttcattagctttaaagttgtttgactttcttgtaattagaaaataatatttagaaaatgtgtgtcctctgctggggcagcaactgttggtctgtctcgagggagcagcaggcctgtttccagcctgacaactgcttgtatctttacctaggcctctggctgaaaatacactcaagtatctgggcccggtgaggtttcatctttaaagggcccagttccttttaaacttaaatcctctccaggctagatgctaagaggggaatcatggctccaggaggaatgaaaagtgaacagaggccaagcgtggtggctcacgcctgtaatcccagcactttgggaggctgagcctggcagatcacctgaggccaggagtttgagaccactctggccaacatggtgaaaccccgtctctactaaaaatacaaaaattagccgggcatggtggtgcatgcctgtaatcccagctactcaggaggctgaggcaggagaatcgcttgaacccgggtggcagagattgcagtgagctgagatcgtgccactgcactccagcctgggtgacagagcaagactctatctcaaaaaaaaaaaaaaaaaaaaagatgaacagaggcaggagcctgggctgggggaacctcctcccatctcaggcctggaaatagggcttctgcccttctgtgggaaaaggcactgttaactgtttgggtgagaaaaaacacctggacccaacccccagataagagtggaggtcagggaggaacgcagcccccctcaagaacagcggggagaaggcctatcagaggctcatcccaccctgttccctgccatgctttccctgtatctataccctcttctcctctgtcttggctgggaagacctagcaccccaaatggaataatcctgggagggtaagagctcaacaggaacaaaattacttgcaggatggcagggaacaggcagggaggtgttgcaggtagagggaccagcaggagcaacaggccaagaagatagaagggcaggaagacacctggtcacagtccacagcattgcactctgtgttagaaaggcgtgacatgagtttatcgacccagaaggaggtgacataagggaagctgggcccaggtcggcgtgcgaggagagttgcatagcaacagtgccagcgcagaatgcagtgtgccctggtgcctgggacactctttctaggatgtggcccagggcaggcatgacagaaggagccaggcatgaagggaaaggtgggacccagaactccagtacagatcgggtgttcagagcctgtggcattctgtggttaggtgtggtgacttctgctgtgacttttccattctcacccacagctggaagtgaggctccaggctggtggcattgtcctgggctgaactgtctcctgaaattcccatgttgaagccctaacccctagtaccacagaatgagactgtatttggaggtagggtcttcacagaggaaattaagttaaaacaaggtcattacgatggcccttggtcccacctggctggtgtccttatgagaagagatgaggacacagacacgcacagagagaagaccacgtgaagacacagggagaagatggagagaggcatcagagggagccagcactgctgacacctccgtctcacatttctagcctctcgaattgcaaggaaataaagttttgctgtctaagcca

SEQ ID NO: 13133 - DNA, 4129 bp, Homo sapiens
ctcaacctcaggaagtcagtccctgggagccatgaagtgcagcaatgacaggcccatctggagaagacatgacggctgggtctgcaggacccagctgaactcaggagcagatttggggatggcaatcaggtaatgtcggattctgtctcccctgccttctcacatccagtaggtcactaagcctagtcctgtcttctatatatatatttctggtctagactcttcatcctcactgtagttactgaacttcaggctgccatcacctctctctcgactgtgggaagagattatggttacctaactgatttctttctgctctccttcctcttgtctattctgccctctcctgcccacataacctttctcaaatataagtctcatcatgacttttcttggtttatatactacctactaaataatcaaaacatcttagtagagaatataaggcccctgtcaatctctccttccagaaaggtaactatggaggctaacacagcactatgttgacttctgcttaaccctggctacaggaatgcctctgaaatttccagtttaagtattgttccttgtgtaagagcacaaacttactgtaaatcctgcccttacataaaatcatccttgataaacttgtactgacttaaatcctgcccttagatcaaattcctacccattccctctgaagcacgtgtaccctttccctatggtatataatccctggtctgaggggtaatggtgcagccacccaagaccatacttctgtccataagttccccagtaaaatcaccctccaatggcacactggacttctttgtcgctcagctccttctgcatttgggagccactttgtgtacatggccctttcaccaaacagtaacacttcctcaataatggccaacacttattaaacatttaccatgtgcccaataccatgcttagtgcttaacgaagatgatctcatttgatcctgaaaactaccttttgaaccagccaagcattatgatccgtatgctgtagaaggtggaattggagctcagagaagcaaaatgacaaaggtgacaaagctgcagcagagctggggtttcaaccctggcagtccaattccaggcccctgctcttcccaccagggacttcctgcagccttctgaacctattacgcattttcctgcctctgtgtctgcagatgctgttcttctacctcaaatgccttgatccttattctcttcacctggacagttcttcttcatcatccaagatccagctccttcctgccttctttaagaagccttcatggacctctcccctgggttatgccatcatagccactccatgcaattctctctcatagcacttatcttgctacattgaactgtctgtctctctaacagagtgtgagcccgccttgaaggtaggtaccctagcctttaccttgacatccccatattcctagcagagtggccaacacgtaataggtgtgcaatatttgtgggtttaaagacatcagccgctggataaagactgaggctctgtcttccggatcaagtaactgggctacaatgcctaggcagatctccatctgttaaatcagattagcagtctgcccagttcctcaggtgttgaaattttagaaactctccccccaggactctaacaggaatccagagttgagaaccactgctttcataaaagcagattttgtggaggcaagggctgccagggtagaagcttgctaaggaaaattacacaacatgtttatacctgcgaaatctgtgtaaaataaacaccagaaagcaactaaaggagataaacttccaaagcatgggagaaaataccaacccaaagttatagtttaggaagacacatgacattgacagtcattaataaaatgcaaagtaactctaaggtatcgttgcacaactgtgagatgggcagaaatatgtaataatgataaaaggctgccaggattatggcgaaaattgttcccttaaaaactgctgttagcattacactttgattaattctactctgttttgagacaataatctgcaactgtgtaaccaaagctcgagaagtctttgttctatttttagaatatactataagaaaataaagaagaatgcagtttattcaaaattgcctgtagcagtggcatgacataaaagtgaaaaattagaagccatctaaatactgaattttgaagactagttgaagtaaattatggatcacaaagtaaattctggagcataataaaacactatgctaccattacaaatgacgaatatcttacatttctcacacatggagatgtgtatgaaacaagaaaaaggctaaaaaaaaatcccccatgctttgtgccctgcgatgagtcacataacagcaaatcaatacaaattcacaaagactggaggtgcattcgatgggcaaaaaaggtactgttcattagctttaaagttgtttgactttcttgtaattagaaaataatatttagaaaatgtgtgtcctctgctggggcagcaactgttggtctgtctcgagggagcagcaggcctgtttccagcctgacaactgcttgtatctttacctaggcctctggctgaaaaaacactcaagtatctgggcccggtgaggtttcatctttaaagggcccagttcttttaaacttaaatcctctccaggctagatgctaagaggggaatcatggctccaggaggaatgaaaagtgaacagaggccaagcgtggtggctcacgcctgtaatcccagcactttgggaggctgagcctggcagatcacctgaggccaggagtttgagaccactctggccaacatggtgaaaccccgtctctactaaaaatacaaaaattagccgggcatggtggtgcatgcctgtaatcccagctactcaggaggctgaggcaggagaatcgcttgaacccgggtggcagagattgcagtgagctgagatcgtgccactgcactccagcctgggtgacagagcaagactctatctcaaaaaaaaaaaaaaaaaaaagatgaacagaggcaggagcctgggctgggggaacctcctcccatctcaggcctggaaatagggcttctgcccttctgtgggaaaaggcactgttaactgtttgggtgagaaaaaacacctggacccaacccccagataagagtggaggtcagggaggaacgcagcccccctcaagaacagcggggagaaggcctatcagaggctcatcccaccctgttccctgccatgctttccctgtatctataccctcttctcctctgtcttggctgggaagacctagcaccccaaatggaataatcctgggagggtaagagctcaacaggaacaaaattacttgcaggatggcagggaacaggcagggaggtgttgcaggtagagggaccagcaggagcaacaggccaagaagatagaagggcaggaagacacctggtcacagtccacagcattgcactctgtgttagaaaggcgtgacatgagtttatcgacccataaggaggtgacataagggaagctgggcccaggtcggcgtgcgaggagagttgcatagcaacagtgccagcgcagaatgcagtgtgccctggtgcctgggacactctttctaggatgtggcccagggcaggcatgacagaaggagccaggcatgaagggaaaggtgggacccagaactccagtacagatcgggtgttcagagcctgtggcattctgtggttaggtgtggtgacttctgctgtgacttttccattctcacccacagctggaagtgaggctccaggctggtggcattgtcctggctgaactgtctcctgaaattcccatgttgaagccctaacccctagtaccacagaatgagactgtatttggaggtagggtcttcacagaggaaattaagttaaaacaaggtcattacgatggcccttggtcccacctggctggtgtccttatgagaagagatgaggacacagacacgcacagagagaagacacgtgaagacacagggagaagatggagagaggcatcagagggagccagcactgctgacacctccgtctcacatttctagcctctcgaattgcaaggaaataaagttttgctgtctaagcca

SEQ ID NO: 13134 - DNA, 1316 bp, Homo sapiens
  misc_feature (933)..(933): n equals a,t,g, or c
aattattttattgacaaatcccagattagaactcatgttttccaatactcagtgctggagcctgtccactatagtttttttttttttttccaaagttttttttagcataggggatgtgaaaaattctaataacagttcttagtccctctccatatcctttttttgtgctacttaatttgattttttaaaaagcaaaggggaatgtttgcctgaagtgtacaggagcgattagctcaaggaaaagcactaaaacaacctctaggtttctcctgtccaatggcagtgtcccacatcaggttcataatggcgacatgctaattccacatgggcagagccaatgccaaggcattggtgtagtgttactgggaagagaaagaaaagccatattctcacagtagcagggaagtggtcaaaacagtcaggtgtgtgttgatggatgagcagattttcccagaatttcagaggtaaagaagatcacatgtgggtttttattggttttaagtgaaatttttttcctttgtgtgtgagtgcgtggggggggttttccagtggttattatcaaaagcagtttctggttttgctgaaaggctagaaatgacaactattttcagagtttctaggtcttgaaacatcagtcaacctttcaaagccagcattgatcaagaaggaaagaggtttttctaatgaggaaaataaaatagtaaatgatactttgacattccattagttgtaggaatgtgtgccccaactgactaccttgctttgctctctctctttccctctcttttctaagttttgctaataataaaacttaggaagtacacatttaggaaactgtctgtccttgtgactgatggcatttatacataaaggccacccggggtgtagggggggaggttcatgaatgcagcacttcttttcttttttctgggnatatgattccgtatcaaattttaacttctagatgtttatttttttaactgcagtcaaggcacaaaccagtgtaaatcagctgcacaaatgtttgtcataataaatttttattaggttttatattggaagccatttagaaactagtcttataatcactcataaaacattagctatcttattgtttttcaagagtatgtagagtatagtaattttttagtaacatcccaaatccgtctttctccaaacacaatacagcaaaaatgtgttttctgtgattcagtaagtcagattgcattttgagtattcatgtagttttccccacccccctgaatcaggaattttcttcccccattattattgttttcttaaaaaaaaaaaaaaaa

SEQ ID NO: 13135 - DNA, 561 bp, Homo sapiens
gaatttggcctgtgtctttcttagtataggctgggaccaaagtaccatggaaaatctttttagacttggagaagaggaagcaaaataagaagaaaaaggaataagctagttgcctagagaaatgcaaaaactgaagatcttttgtaatattcttttaaagttttctttaaaagctttggggacatatttgggtggaattaatgtcttactaacagtgaggatctgttcattctgtttccagagtgtcctgccccaaaccctgcgtttgagctcagggattgttggaaatgcggggtcttgctagaaggtaaccagtggcttgctttcttaggggaaagggaagttaatcacaagtgcccacgtggcagcctttccctgtcaatcaaaagaatagaactagctgggtgtgaagcacttgcggttttagtgttatgtgtggttagggggagaggttgcgagggcctgtggttgttaccaaattctttgaaatggaagtatgggtacaaccaaaataaagaataggagagaaaccctggtgctctgtgtgggggaaagaaaagt

SEQ ID NO: 13136 - DNA, 569 bp, Homo sapiens
ctttttttttttttttttttctgcattgccagggtaaggaaagacaggcagcctacttccaagcaagtgatctgttataggtgggatagtgaaactgtcacttacaacattcttgtagagaatgaacacaagacaacactcatactggcaaagagagaagctttgaggggaggtgtgtgatatattgagtctacctttatccctctttccctatcgaaccaccttcccctcatggtaaagctgggacctaggtatattggtggcaacatttctctgctgctgacctcaaagagactaaaagcatacgtgattgaaatgaaaaataaatgagcagctatttataaataactcctgttaacgaaggcatgtgtttcatggaaataatctcatacaaatgactgctttattttgctccctcctccattcccttgtatccctcctgctacccactaagtggggccagggcaaggctttccttacaggtcccctattttcttaatttttctggtggcaagcagcagaacagagtggtgtcactgggttgcctttagaactttagtcattaaatc

SEQ ID NO: 13137 - DNA, 569 bp, Homo sapiens; identical to SEQ ID NO: 13136

SEQ ID NO: 13138 - DNA, 411 bp, Homo sapiens
ggggtaaaggtagactcagtgggcctttagaaatgggcccataaatggatattacctttcgaaaaaagtcaaattcagttcctttctaatttcggttcccaactaatagctgctatgcaggaatgtggacctagtattgctggatgttttattttcacaaaatgtgggatatcttgatgtttcagtgaatgctcccaattagtaaatgctgacaataaaaccagaaaggctctgtatcccaaataaaacaaaggtcatgggcttagagtttgtgaattgtgctttgaagttttgggcttgcaacacaagaaaacaagtaggctgtaatgaatggcatttagtcctgaggcagaggcaaaggtggcagcacacgtggctgggaacttgctgtctgctgggatctgtcctaag

SEQ ID NO: 13139 - DNA, 411 bp, Homo sapiens; identical to SEQ ID NO: 13138

SEQ ID NO: 13140 - DNA, 86 bp, Homo sapiens
cacccaccaccatgcccagctaatttttgtatttttagtagagacagggtttcaccatgttggccaggttggtctggaactcctga

SEQ ID NO: 13141 - DNA, 238 bp, Homo sapiens
tttttttttgagatggagtcttgcactttcacccaggctggagtgcagtggcgtgatctcggctcactgcaccctccgcctcctgagttcaagcaattctcctgcctcagcctcccgagtagctgggattacaggcgcctgccaccacacccggctaatttttgtatttttagtagagacggggtttcaccatgttggccaggctggtctcgaactcctgacctcaggtgatctgccc

SEQ ID NO: 13142 - DNA, 116 bp, Homo sapiens
agtagctgagattacaggcatatgccaccatgcccagctaatttttgtatttttagtagaaatggggtttcaccatgttggtcaggctggtcttgaactcctgacctcaaatgatc

SEQ ID NO: 13143 - DNA, 89 bp, Homo sapiens
ccgtgcccagctgatttttgtatttttagtagagatggggttttgccatgttggccaggctggtcttgaacgcctgacctcaggtgatc

SEQ ID NO: 13144 - DNA, 97 bp, Homo sapiens
gtgcaccaccatgcccggctaatttttgtatttttagtagagacggggtttcaccgtgttggccaggctggtctcgaactcctgacctcaagtgatc

SEQ ID NO: 13145 - DNA, 95 bp, Homo sapiens; identical to SEQ ID NO: 12822

SEQ ID NO: 13146 - DNA, 103 bp, Homo sapiens
acaggcgagtgctaccatgcccagctaatttttgtatttttagtagagatggggtttcaccatgttggccaggctggtcttgaactcctggcctcaagagatc

SEQ ID NO: 13147 - DNA, 1645 bp, Homo sapiens
ccatgcccagctaatttttgcatttttagtagagacggggtttcaccatgttgggcaggctggtcttgaacgcctgacctcaggtgatccactctccttggcctccctaagtgctgggattacaggcatgagccaccgcacccggccatgttatttcttatttatgtgtctttgcttatgcttttattttcgctttgtctgtccctaccacacctacaacccccttccttgagggaaatactgattcctgttcattctttaagattcagcttagtgtcacctcttcatggaagtcttgcatcatctcttctacttcagcactgtggcactttgagacaagttttcttttaatcccccttgttttgtgcgtgtgcatgcagaccaaatcttcgtcagcactagatattgtcatttattaaatttaatccttctaatgtgtagcgatatctcattgtggtttttagtatttcactgatgcctaatgttgtgcatcttttcatgtgcttatttgctatccgtgtatcttctttgaagtatctgttcaaatattttggtaatttaaaaaataagattgctttattattttgttttgagagttctttatatattctggagtgtttttttttcagatacgtgttttgcaaatatttattcttaaaccctgacatgtcttttccttcaaatttcaaagagcagaagtcttaacttttcttgaaatttagtttattagtgttttttcttttatggatcatgctttttatgttatatctaagtaatctttgcctaattcaaggccacaaaacttttctctgatgttttcttctgatgttttatagttattggttttatatttaagctcatggtccttgtaagtttactttgtgatgcaaggtatggattgatgtttgtttatttatttttccatatggatataccattgttctagcaccatttgttgaaaaatctgtgctttctctatggttacctttttgttgtaaatctattgaccatgtatgtgggtctatttccagcttctcagttctgttccattgaactatgtgtgtcttctttcattaataccaaactctctggattactgtagttttagtaagtcttgaaatcagatagcgtgcacatctatgtttatacctttttcagaagtgtactggctattttagattgtctttccgtataaattttagaattaacttgatttctgcatggggaaatatacagaagaagaggtaaaagatgacttaagccaagaatgatgaaaaggaagttgatacccattaaaaaagatgaaaatgtacgtatcagaggagaaagaaaacagaaactaaatcaaaaaagtggaaagaaggctgggtgcagtggctcatacctgtaattccagcactttgggaggctgaggtgggcagatcacttgggccaggagttcaagaccagcctgggcaacatggtgaaacccatctctacaaaaaaatacaaagattagctggatggtggtggcgtgcacctgtagtcctcggtactcagacgactgaggtgagaggatcacttgaacccaggaggttgaggctgcaccacactgcactccagcctgggtgataaagtgagacctagtctcaaaaaaaaaaaaaaa

SEQ ID NO: 13148 - DNA, 543 bp, Homo sapiens
ccttgttccttgggttatctaattatttggtttgctagcaaggattgtagaaaagaatattatcactgatttaggaaaccagttgctatcatcttaagttaaatgtactagtatgtgtttaacttattatcttcagtcccattccccaatattaggccatttaaaacttctcattcttgtcctgggaactctgttctctccacctattcttgaccatgccagaggttatcggttattcatcaccctcatcctttgtgataaggatgttttattttccctttagttgttctacttattttagagtagtgacagtagagaacaatgcaactacctgatgagggagaaaaaggaagtagtaacaagaaatgccaaattccttgcagaattattgaaaagcaaaatactgtatagcttttctttttcaagtagtgctgtgaaaacagtatatgctccatgcgggtaaggacaatgtccaacttgttcactattgaagcaccctagtgcttggtacagtaaatgttgtaaggaataggcatgcaataa

SEQ ID NO: 13149 - DNA, 659 bp, Homo sapiens
gagatagtgtagtgcaaaggatcatggtttggaatttggaagcctgcgactgactcttcaccctgccacttgctacatgtgtaacctaatgactgaacatctgaacccctgttttctcatctgtgggaataaataaatcatgttaatatttatttccctaggccgctgtgatgcttaactgagagaatgaaggtacaaatgtattgtaaactatcaagacctcgttattagagattggtgtagtagctaatgctgatatttttaaaatgtttaacagtttcttatgcaaaatacagcagtaaaatttatactgcagtgtcgaacacattcagcacagcttcagactcctggctgtgcgtgaaaactccaagaggataccactggtttatgtcacttgagactccagacattgaacagtaattagggaacatgacagtaatttgatttaaagtctgcagccacagagttcaggctccatccctctctccatcattctccctgagtgcaaatccagagggagggcaagtaggtcgaagcagactctgatggtgtttacttacttgccagagattagagaaagtgtgcccactaggtctacagtagtgcaaaaccaagccaaaaagtgagcacttcagtgcactcaatgccaaaaaaaaaaa

SEQ ID NO: 13150 - DNA, 659 bp, Homo sapiens; identical to SEQ ID NO: 13149

SEQ ID NO: 13151 - DNA, 322 bp, Homo sapiens
gtaaattgtaaatttacttttgcttttgaagttaccatattcttcattttttaaattattgcgaaatcttaagcattacactgtaataagtatatcagaaaagcctacttaaaatattatcctaacatcaaaaattgcccaagaaactatatgtatgcctttcagcccataaaatacatatatagagtaaatgtgtcatttctgagattttcatttagaacactgtcatttcccaacggaattaattctagctcatagtccgtaagaactcacctgaaattagattggtatctcagcttctttactgaggcatgtaccaaaa

SEQ ID NO: 13152 - DNA, 322 bp, Homo sapiens; identical to SEQ ID NO: 13151

SEQ ID NO: 13153 - DNA, 2959 bp, Homo sapiens
gaggaagagaaggtcactaccatcatggagatggcttccaagatgaaagacacaggtagactccaagcccctgaagagcaggaaaatactggaggttgaacaccccctactaccccacaaaaggtcaggttgggttctgaccacctcaggtgctgccacctagaggagaaggcaagctaaagaagaaatgttaatgggctggtacttgttagcaaggctagcttaaaggcttcctggcctgatatgtatgggtaccattaataagtgtttattatgtgccaggcactgttatgaatgctttatatacattatctcactgaatcccacagaacagctttatgaggatgatcctattgttggtcctcttttacaaatggggaaactgagtttttgggggtttaaaaacctaaccaagttattaggaagtcatgaagctgggactggaacccgggtttgtctgactctagagcccacgatcttaatgctacctcccactgccatgagtctgggccctagacattgcctgcaccctccacagccaagtgatccttctctctctcctcccaaagggttcatcgtgtttgctgtgcttctgctggtgtcatgcctcatcctcatctttgtcattgccccacgttacgggcaaaggaatatcctcatctacatcatcatctgctctgtgatcggggccttctctgtggctgctgtcaaggggctgggcatcaccatcaagaacttcttccaggggctgccagttgtccggcacccgctcccctacatcctgtccctcatcctggcactgtccctcagcactcaggtcaacttcctcaacagagcactggacattttcaacacttccctggtgttccccatctactacgtgttcttcaccacggtggtcgttacctcgtccatcatcctcttcaaggagtggtacagcatgtctgctgtggacattgcaagcacccctctcgggctagtcaccatcatcttggcgtgttcatgctgcatgggttcaaagacctggacatcagctgcgccagcttgccccacatgcacaaaaacccacccccttctcccgccccggaacccactgttattagactggaagacaagaacgtccttgtggacaatatagaacttgccagcacctcatcaccagaagagaaacccaaagtatttataatccattcctgaagcttggaatatgtgagtgagaggatgagtccgatggtacagcctgccctcccaatttcaaaaccacctggttattttccagtgcaactgttaccaatgggctctcttttcttgagaagttcatttatacctcatcactgtttccaggagaaaaatctttacccaaatagcaatggtggcagaacttcctggaaacagattcagtgaccaaatacccaagtttacatcagtgcctgcaggttccctggaccttccttctcattcattctttcggtgccatctctatgccgttgggaagaagatggagtctgacccactgaatgtagcacagtccaaggacttctctaagatattggtcattggaagttccttcacaccaattctcctcctgagacggaatctccgttgttgttgttgttgttgttttctagcccaaggatgacatagagctggctcccagaggcccacagagcaattggccatgcctccctatccagagctgacagggacacaaccagtgtaaaatatcctgttgcctttgtcacttcctctttggaggcagaagcaagacctcagctgaccttcttactgtgaaagccacttgatgtctcagggaaaaatttcaaccagctcattccccgagcactccagcctggcagtcagcacctcggcatccacccagtccatcccaccatcaccccttccccctctacttacatcctaaggagtcggtcactgagacataaaggcagtaatcgcagaactggaaacaaaacaataatagagccacagccaaactctggtggccaaacccagtgttgcattttgtcttactctgaaagaagaacagcaaattcactgcttcaaagtggcctggctgccaagctagaatttggcagaacgcactttactattcctcaaggagtcaaccaacctatgatctggggaggtgggaagaggatgaggagcaaagttgggatttggcagaaggcagtcccaggctctctggatactaggggctaacttttgtgttgactctggtgctcatctgggaacttaggagaaacgagctcaggggtaatttctgggttgcagccttaaaggcttggacagctgtgaatctcaatggccaactggaggtgcagacttggcatggggtgcattctagctgttgaccagattgctaccgagtcccctcctccactgatgagctgcccacactgggaagcagcatgccctgactgttccaacaccacctgctatggggagtacctttggtcccctcacatttggccagaggcatacaaaaaaccagagcagctggagagggagataattactattccttcccttcctatctcctttctagccacaagagtgtgggggttggagaagaaccattagaaagggaaattagtgggctggtgtatctggaaagagggaagacttgatcctcagccccgaggttggtgcagggcctcccctgtgtgactctacctgcactctgtgtttatatcctgtgccctaagtgggccaagcccaggtaaattcctgctggccttggaactccaaggtttggctgaccagcagactggctccctgactcttcagcctcaaatccccagtttttgatgaatgtggatttctgtctgtaattaaaagcaatgcaacaagttggctcttgagaatggcagtaaactgagggccctaagagtgtggtctgcagggtcaagaataaagattacagattatatttacttga

SEQ ID NO: 13154 - DNA, 9815 bp, Homo sapiens
tgcagaggccgcgccgcctcccccgtccgaggtctgcgcgctccgccgcagggtgcagacccggggcgcccgcctgggtttggggcgcaagagcagaggcggagccagggcggagccagcgcgccgggtcccccctgaatcgaaagcgaaacaggggccggggaggaagggcggagccggccccgaggcaccgccccctgccctgcgcggctgctggaccgacgggcgcacccaggtaggggggcggctgagccgcgcagtgcggaccctcgcggggaactgcgccgccgccaccatgtctcaggaaggtgtggaggtaagcgatggctacggctgggccggggtcagccgcgacagaccccgaggagcggccgggaggcgcggagggggcttcgcagttcctggggacccccatcctagaaccccagatccttacccctgcctggcgctcgccccccttgaaaaggaaagtgactcccacgtttccccagagcgaaatgaggcctccccgaggaaaagcgggggctgcagggtcaaaggtcagaggccagagataacctggccgcccccccacaccttaggctgggacgctcgccccagtccgcgccttcccccaacgccctgtggggactttggctttttccaggaaatgccgtaaagggatgaaaggcggggggggggcggcggaggccaaaaccaagggtcaagttcgggccgggagaacggtgcctagagatgggggagggatgatcccgtttccccttcccccaccggaacccccctgtctccatcccagctggagaagagcgtccggcgcctccgggagaagtttcatgggaaggtatcctccaagaaggcgggggctctgatgaggaaattcggcagcgaccacacgggagtggggcgctccatcgtgtacggtgaggctgcaggggtcccgggcctggtgcggggaccgcgcgtgggagcgccgagggggcgtggtctagggagaggcgttgagatcacctcccccggaggtcccagccttggggaggctctgcgtcgcggctctgggtggcctggaactcccacagacccttcaagggcccttcccttatatgcactctcccccgcaggggtaaagcaaaaagatggccaagaactaagtaacgatctggatgcccaggtaacctatcccctcccctcgcaaaggaccgggtcacgggagggagagcaagaggggggacccgacccgttcatggtgactgacccccctctgaaacaggagggaccaggcattgtcggtccataactcatcacccaatctcactttttcacctctccatcatttgtccggccagggagcctgcaaacagtaggcgctcattatgtgctgattgtattcaatgggggagagagccatgaaactaagcaatgaaaggagccaggattattgccatcatagcgggggcgcagaggtcagagaaggcttactggaggaggaggtaccaagtcttaaaggatggggaggagtgagccctgggaggggaaagggaaagaaaggcaggggtcttggggtgggggagggaatggcataagcaaaggctgggaggtggggaagggttgttagtggcagtctctagaaaggctaggatgagcagaggattggggaggagagagaggcaggggaatggaacccttgtgttgaatgaatgaatgaatgaatgaatgaatgaatgaatgaatggctttgaagcacaggtgcatcatggctactttgcttctttgacagctttggtgatgggaacgctgtggatttagcctgcctgaaaggcttagtgtagggctgttaaagagtataataggccaggcgcggtggctcacgcctgcaatcccaacattttgggaggccgaggcgggcggatcacctgaggtcgggagtttgagaccagcctgaccaacatggagaaacccgtctctactaaaaaatacaaaattagctgggcatggtggcgcatgcctgtaatcccagctactcgggaggctgaggcaggagaatcacttgaacccaggaggcggaggttgcagtgagctgagatcacaccattgcactccagcctgggcaacaagagcgaaactctgtctcaaaaaaaaaaaaaaaaaaaaaatgccgggcgcggtggctcacgcctgtaatcccagcactttgggaggccaaggcgggcggatcatgaggtcaggagatcgagaccatcctggctaacatggtgaaaccccatctatactaaaaatacgaaaaaaaaaattagccagttgtgctggcaggcccctgtagtcccagctactcaggaggctgaggcaggagaatggcgtgaacccgggaggcggagcttgcagtgagccgagatcgcaccactgcactccagcctgggcaacagagcgattctccgtctcaaacaaacaaaaacaaacaaaaccagagtataacaaaacatgtatcatagtctacatttatacatataaaagtatgataaaaatgatagcagaggggccaggtgtggtggctcacgcctgtaattccagcactttgggaggttgaggcgggcagatcacttgaggtcaggagttcgagattagcctggccaacacggtgaaaccccttctctattaaaaatacaaaaaattagctgggcgtggcagtgcatgcttgtaatcccagctacttggcaggctaaggcagaagaatcacttgaacctgggaggcagaggttgcagtcagccaagattgtgccattgcactctagcctgggagacaagagcgaaactccgtctcaaaaatataataataataataataataataataataataataatattagcagagagtagcattcattgagtacttcccacatggcaagattccaggaatttatttatttcatcactgcagtgaccccaggagacaggtcctattatttatccccatttcacagacaaagaaactgaggccgaagtcacttgccagcaagcaggggcagctgcgatttgaaccctggccacctggagtcagagcctgggctctaacatgcctgtcagtgggaacccagggggcagggagtggcttgcccaagtccccacagctggaagtgatacagctgggatttgaacccacatctctctcccacttagccgagcacaacgtggcctcaaaggggcgatatgtcacaacatcaacaagcatgtggcatttgcaggcaggaagtgagtatgggggtcaggctagcctcactcaggcaagccctcccctaagcctcagtttccccatctgagcaataaggtaacaggtgtgcccacctctcagggctgctatgaggacaactgaggccacacacctggctctcaataagtgagtggtgctctgtgagcttctggcgagttaggggcaccctactcattgcggccgggggcctcccccagcaaacgggtggaaagaggcctgagccccatccccagtttctgcccctgctatctccacccaggatccaccagaagatatgaagcaggaccgggacattcaggtgagttggtggctagggcttgggatgggggagttgggagggggacatctgcaggcacagaaggatgtccattagggcaggaggggagatattcactggggcaggaagaggactcgtctgtagggagaggagggctgatgcttatgttggtgcagaaggggtgacacccccccacctcatccccacctgccccattccacaggcagtggcgacctccctcctgccactgacagaagccaacctacgcatgtttcaacgtgcccaggacgaccttatccctgctgtggaccggcagtttgcctgctcctcctgcgaccacgtctggtggcgccgcgtgccccagcggaaggaggtgatgacctaaaacttaacctcgactttgactgtcccgaactccactcctgactcctatcctcagtgactgtacctctgacctaaggatttcaatcactgagagtccaatccctgacctccaaactcagagctcagccttgatctctgatcccaacccctgacccaggactggacttctgaccttaaatgtgagaagcccaatacctccttaccccagaacctgacccttgacccacaattgaacagctactacagaaatcaaacctggccaggcgcagtggctcatggctgcaatctcagtgttttgggaggctaagtagggaggatcgcttgaatttaggagtttgagaccagcctgggtgacagggtgagaccctgtctccaaaaaaaaatgtgttttgaagacagggggtctcgccctgtcacccaggctggagtgcagtggcgggatcatagctcactgcagcctccacctcctggcctcaggtgatcctcccacctcaacctcccaagcagctgggactacaggcctgcgccaccacacttggctaatttttgtattttgtgtgtgtgtgtggagatggggttttgccatgttgcccaagctggtctcaaactcctgggctcaagcaatctaccacctcagcctcccaaagtgctgggattacaggcatgagccactgtgcctggcaaaaaaaaatttttttaattagctgggagtggtggtgtgtgcctgtggtcccaactactcaggaggctgaggtgggaggatcgtttgagcctgggaggtcgaggctgcagtaagccatgatcacaacactgcattccagcctgggtgacagagcaagactctgtctctaaaaaaaaaaagaaagaaagaaaagaaaccaaatctgacctcaaaaacacagccccaaatctggcttctgaacctcctgactagtagttcacttctggtcaatgcttaactagttcttgcaaaagaggcaggaagccaagatgtgtagtgtttgccaatttctgtggtgtaaatattcccaccatggtcaatatcaggctacccacgtgaagtcactgattgagttgggttgctcaagctgaggccagccgctgcagcacactgctagccctgaccccaacctcagacacctctgacaatccttggtcccctctctgtaccttcctgcccaccaccaccaggtatcccggtgccggaaatgccggaagcgctacgagccagtgccagctgacaagatgtggggcctggctgagttccactgcccgaagtgtcggcacaacttccggtgagggcgctgacccccagctccccctcagccctgccctaccccagccctgcccctccctgccctggccccaccctggcccagcctcgccctcggaccctcacagccctgcccgcccccaggggctgggcacagatggggtccccgtccccctgctacgggtgcggcttccccgtgtatccaacacggatcctccccccgcgctgggaccgggacccggatcgccgcagcacccacactcactcctgctcagctgccgactgctacaaccggcgaggtgaggctcttctcccccaacagcctggacagtctttgtccccttctgtgcctttaagtccccaaatctccactcagtccactttgtctcccacagcagcagccactgcttccacatggcctccatgaccccccagtctccgtggtcttgcccaggaggctctgaggtttcaccccagtggcccgtgcctgagggtccccatggcctctgcccccatggtctctgggtttggggcccctgttttgtcccctgtaatctcaggtgacccccatgtccccaggtctcctgtatcttcaacacccctgaatgtccagttgtgctggtccccgtatctggtggtctcagctcctccctagagccccgcgtggcctaagtcccctcctccccagactctcatgggacctccagccccatgtctgcagcacctctccctccctagagccccacgtgcctgggacatcctgtgctcaccccaagagccggaagcagaaccacctgcccaaagtgctccaccccagcaaccctcacattagcagtggctccactgtggccacctgcttgagccagggtggcctcctggaagacctggacaacctcatcctggaggacctgaaggaggaggaggaggaagaggaggaggtggaggacgaggagggcgggcccagggagtgacccctgccaggtgcagatacaaaccagacacggtctgtggctactttgtgttattataagatatgagctcaaaccgagatatgaatgaccttggggagccatctgaggccaagatattgacgggggggattcctgggtcccattttcagcgcccagggtcacagatccacagtgggaagttctgtgggacacattggcactgagccacaaagaaggtgtggccagaacaacttgggctcctgctgaccaatgtcctctagggcctaggggacagaggaacacagagtcacagcttcaggggccgaatgagcatggcggccttcctgagagaatatgccccaccacgaaactcagcccagtagacaccatcctggtagcggcttcggtagtggccgccgtggtgccacacaccgttgaggttggagtgggcacaggcatggtaccaccagcctccccgctggtacagggcacagttacctgaggggagagagagagtccatgtcctctcaccagaataaaagcctctacctgcacctcacagtgcaaggcttttgccaggcatcccctggcccctcccattcttattgaatacaagccctgatcttccatctcctcagcaaaaaaataggagccctggccccccaactttcttcagagtaatagccttaattccttccctatctccttaccaaagtacaagtcacatctttcccaccttttctgcaaactaggagtctaccgttcattcctttatcaaagaaaagtatctacttcctttctagaataagagtactagctctcaccctctgccctttacttgaacaggagtcttgattctttttttgcctcatcagagaaggaatctggactccccatccccccaccaggataaaagtcctgacctttgttctcttgacggaataaaagcttgcttatccttatacttaccagaggggcgtcttacctaccctacctcctttcattccctcaccagaacaggagtcccgcctcccctatcctctcaccagaataggagttctccttaccagaataggagtctcggtccctatccacggtgctgaagggcttgtcattgtgccaggaaagagagtctccagcatcaccatggtactggccaagccgcaggcggtagtggtcgctctcgggttccagggagaagccatcatagtgggcacgtgctccacggcccccccagtcctccaggagaaccagcagctcatggtccccacggctggtcagctgatacacgggttcaaggcccagccagtattctccgtctggccgcccaaagcccgcctggcagggcaggaaagtcaggaagccagaacaggctccctccccttccctgcctctgcccacctgtgcccaccttatagtgctgccaggtagtgaagaagttgactgaaccatcttgcctccgctggatcacagtccagcctccaccctccagttgctgctcacaccatactgacactacgtgacggcccactcgcagttcatacactccactctgttcatggcctgcctggcgggcctctgcacaatcctgccacgggcctgtgggcacagggataggggggaggcacagcctgggctgaccaatcccttactggagcaagagtcaagattctcacaggtcctctcaccagaataagagttctgcctctcccacttttctaccaaagagtcctgcctctcccatttcctcaccagaataagaggcctgcctctcccatttcctcaccagaatccgagctccaatagccatttctttacctaagaatctgggtcccttgtctctaatcaaaggaaatgtcaagtctggggttctttttttttttgagatggagtctcgctctgtcactcaggctggagtgcagtggtgcgatctcggctcactgcaacctcatcctcccaggttcacgcctttctcctgcctcagcctcccgagcagctgggactacaggcgcccgccaccacgcccagctaattttttgtatttttagtagaaatggggtttcaccgtgttagccaggatggtcttgatctcctgacctcgtgatccacccgcctcggcctcccaaagtgctgggattacaggcatgagccatcgcgcccggccaactctggggttcttaaaccctggttttttatggtctcctcaccataatataagtcctgaatatgatactctgaaccagttcaaactcttaccaaagtagcagtcccaaacatcgcctcactaaagtaagagtccctcctcttctatttcttgtttctcctattttcacaccttagaagtttggtcttatttttaatcagaataggagtatcatttcttctggtcttctcacaatgagagaaatctgccactaaaatcctgactcctcaattttcctctacccacaattcctcagccctaatgtcgacttacccacaggcttggtggggaccgcagggtgacctgcaggcatgggagaagccatgggctcctgctgtctctgggtctggtctctctggggctctggggctgggtccagcatcctactggtgtcactggtgctacccacaagacggaccggaaccacaggcaccagtgggggtggcggcaggacctggggtgacggagaaagtcaggtgtaattgcactaaccctcaggccaggaggcctggtctcaggggcagaaatggtggataaatctcccagctcccaaatgacctggacatctggcagtgggggtgtcccagccctaggaatgatcctccccaaaagctaaacaacttggctttaaagtgcagacaggctgggcgctatggcccgtgcctgtaatcccagcactttgggaggccgaggcgggcggatcacctgaggtcaggagttcgagaccagcctgaccaacatggtgaaacctccgtctctactaaaaatacaaaaaaaattaactgagtgtgttggctcacgcctgtaatgccagctactcggaaggttgaggtaggaggatcgcttgaacctgggaggtggaggttgcagtgagccaagattgcaccactgcactccagcctgggagacagagcgagactccatctcaaaaataaaattaaaaaaataaagtgcagacagagctgggcttaaataccggctcttggtgctcatggtttaattgatctgtgccccagcctcctctgtagagtagggataataacaacacatccaacagtatctaacttactgactcctctcaccaaccctgtaacgtagggactgtcacagagcaacattctcttatcccaaacccagaccaggacacgttccagaattcagaataacacggctggatttagacacagtgacacagggagggttatgtatatgcatgtgtgtatagaatatacataacactcctaaaggggtttttggtctttacgtgataatgatatgtttaattataggatcctatgactattcacattaagtggttaagtgaaggctataaatagccaccagtcactttttgacccaaataagttaccagaaggggcgagtaggaatccggttttcagggttttgcggatttcagaactgtggataagagatcgtggggttgcaaaacccccatttcacag

SEQ ID NO: 13155 - DNA, 283 bp, Homo sapiens
gccaggagtttgagaccagcctgggcaacatagtgagaccccgtctctacaaaaaaaatagaaaattaaccaggcatagtggcatatgccagtagtcccagctacttagcaggctgaggcaggaggatcgtttgagcccaggagttagaggctgcagtgagccaccatcaaaccactgcactccagcctgggcaacagagcaagatcttgtctcaaaaaataaataaatgaataaatatccatctgggggtgtaactttaacacttttacctataggggtgtg

SEQ ID NO: 13156 - DNA, 278 bp, Homo sapiens
ctcactcctgtaatcccagcactttgggaggctgaggcaggtggatcacgaggtcaagagatcgagaccatcctggctaacacggtgaaaccccatctctactaaaaatacaaaaagttagctgggcgtggtggcgggcacttgtagtcccagctacttgggaggctgaggcaggagaatggcgtgaacctgggaggcagagcttgcggtgagccgagattgtgccactgcagcccagcctgggtgactgagcgagactccatctcaaaaaaataaaa

SEQ ID NO: 13157 - DNA, 13830 bp, Homo sapiens
gtgatttattttagtattgtgaaaaagaataggctattgcatcttctgtattatggtttcctgtgaataatttaccatttctttctgttttccattgaactattcagtggtcggtgaagatggtaagccttatgtgctgatctatatactgtgccaacattaagtaatctcaaaacattgttttgtttaattcaaaacaagtggtaaattacatcccacgttttcaccttgtgtgttttttctttttatagtttcatagtccagcatatgccagtactcttgatgtcataagattagaaaatgtggttaattgtcatcaacccattaagttcttaaatgtcattgaatggagtccttgtcatgttacagaggagcgtaaaattgtggttaaacattttttaaagattacatggtagagccacagtttgttatgcagaaggaaaatttagcaaatattattttgcttaatagcctttaaaaaatcgtataaatttgatttgtagttttatccccagagtcattagatttttccaaaaaaagaaagaaaaatttcaaactagtatcattatggagttagtccttggttcttctgtgctattgaaggagaatagaaacacaaatgatctaaatatcctgtgtgtgtttgtgtggggggtggggcggggcggggaaggtgtgtgtgtgtttgggatgttccttggtatgtttatttcaaacaaattaatggatctacattaggaactaaccccaaaattattgtataggaagctactggaaaatagaccactcttttttacattgttggaatcagccttttataaattcctttgtagtaagagaggttgttaaatgccccagaggtcttctgaacatccataggaaataaagttaagtttaattctcatattctatgtaagaatagagttccaatgtcaaatgggatattagaaatgtaagtgcctcagtgtttactgttcataaatttgagaacagggtttgataagggataagtggaattctggcagatttacttgtaggttattgtgagtttatcataattttgacaacaaaaaaaaactccacagtatgttgaaatgcatttcttcattttattcaataatttttcaagatttttagaaatatttttaaaaatctaaattaagaagtttatttttggcatatatatatactagttttcaaaacttgtactccttttctgtaatcccagctatttgggaggctaaggcgggaggattggttgagcccaggagttcgaggctatagtgagccatgagagctatgatcactcaactgcattccattgtgggcaacagaatgagaccctatctctacaaaaaaccttcaactccaaagtagattaaatatgacaaatttatgttgcaaattaaccagtaaatctaaaggaactcaacaaaggaaatttcaccattgatttatttaggccagattgggttgattgatatccttgtttctggtgattggtaaatgaaaaaaaaaaaaaaaaaaaaaaagcaacacttaggatgccctacttttttctagcaagcttgttgaatatccataatctacaggccactggggaaagaggctagggattctgttattaattaaatgttacatttaattatagctcatcctaggagtgagttttctcttttctgaaagtaagtgactcattcttacacatggtgaaataaagctatttagcatatgttacaggcataagtggcccaaagagcaagatcgtatttgttttgagagctccttttagcatcactttaacaaatttgaatatttatattcttttttcttttctttaccttttttttttttttttttttttaaaagacggagtctcgctcttgtcgcccagcctggagtgcaatggcgcgatcttggctcactgcaacctctgccttccgggttcaagtgattctcctgcctcagcctctcacgagtagctgggattacaggcgcctgccaccacgcctggctaatttattgtatttttagtagagacagggtttcatcatgtcggccaggctccagtctggcctcaaactcctgaccttaggtgatccacccgcctcagcctcccaaagtgttgggattacaggcgtgagccactgcgcctggccttattcttagaataaccattttgaaaagaaaatgaatagtgacaggcatcatcaatttctggagtatatataaagatttaagtaatataggtttatattaaatagattcaatagcggctaatattggttctgttgtaatctgtaatataagtaacagtgattaaaataacatttaagggaaaaggtgtcatttggatcagatgtttacgtttaaatactagtactttttcttaaattgcatagttttttgaatatcaaaactttaaaaaattttcagacatcaaggatctttcctaaagaaggattttatccttctttcagtaacaactgaggtatgttatttggtttacaaaaggttaattgaaaatatacacttgtttgaatataatttctgctcagtggatagttctatctttggtttttaatgaccaggtatgttttgaatggtttaatcagttgttcaaagactatatgtagtgttaaagtatatttcattagattgtctttgtgaggtaagtttcttaattatattcatattttcagtttgaacatttgtaacattctgaatgtcatggcaatgggttttatttggaaatgttgtgatatgttatatataaaacaataccctgtatagacaagaatgttacgtgtttccattttgttgttgttgctgtaagaaggtttacatgtattcattataactctgccaagatttgaaagtaatgtgatactacctaccagttatctgtatctgggtatgattttacttattctgtttcatggttttataaaatgactgaaatttgagctcttttcttcagtacattgttttcattaacatatacgcataaacacacacatctgtgtagatttcttttttttttaaggggttgcttgaggcaaatttgaaattaaacttaagattggtatgtattcttattttatagcaggtatattttaaaaataaaatttcccgaaaatgtctattataatgatttagattctcttttcagggcccagcactagaagatttcagtcatctgccaccagaacagagacgtaaaaaactacagcagcgcattgatgaacttaacagagaactacagaaagaatcagaccaaaagtattattcctttaagttttctctatcattattattttaggatctactttgagtgacgcccttaaatgtgatatacagaaggtttaaaaatcatatatcctaattgaaatatcttttgagagagaattatactcctaccctggaaatttttatggttaccctgtcataggttagagaatttccttggttgcagatttttattgaatgctaatatgccttcattaatttgcaaaaaatttcttgatattttattatcaagagtagtttcatcagcactacctcttatactttgatatattttcattttgcttttatatataaattgatttcattagcaacctgaggctattttgtagcaaaacatttggcaaacggtgcttgattactgacggcttcatatttgttcacacataagtttacttttttatttcatttttataagacgtttcctctagtttaattttttaaaaatagacatagaagaattattcacgatcattaaagtgttattacaatgaattggtgacttgctatgtcttcacttacgataaaattggggcttaaattgtagcatgagagattgaagttttgatgctaagaattagtgtatcaggtgtgatgtggcgcttaatcataatgaaatatttgcactacctttgattctcattcacagtagctgtgttctgtaaagtcactgtgaacactaaattatggaatactgaaacattgctcttagggagatacagggttaggttctaggtagccactggtcacaatgtttcagtcagctgattggcacataacctttttttatttgtgtttctgtgtaaaaacaccttatttcatatatgatgttgatttattaactttgatttttttctaatagcactgtaactcatgcttgaacaaagcttatctaagattagaattttctctgtaaggtacagccttcttgtgcttcagaacactagacagcacttgattgccatgcttaggggctattttaaacaccaatatcaacaaaaagcataaaaatatgagaaacattgcactaaatgagtagattgcaaaaaggatacatgtccagaatatgagaatacgagcaagaaggccagagtgtcactggtttgaccacagtttagaacttgaatgtacctctggtgactcaaattttcccagatatctccatgtccaaaacaagagtaaaggcacagaaatgtgaatgttcttgccatggactggaattagtgctaatccagagagacttggttaaaaattatgtggaacataataatagaagttgaggatgaagaagtataggacttgtgaaaaattctgaatgcttttctgtgaagttctgtaggtactacagtccccagttattgagagaaggggtaacattattagctctgtgtgataaaagataattgaaaactgtatgaagagtaaatagtataggaaagagattggaggtagaagcctttaacaatccaggtgagagatactgagggcctaaattaaggcatgaccatgggaatagaaaggaggaatagataaaagaatcatttcaaagccaaagtaggttgtactttcacctgattggatgctggagaagagaaaacatggaggaagcttaaaaaaaaaaaaaagatttgtagctatagatttaattgcaacaataagaaaaaagtttagggcaaagataaagattttgtttatgttgatttttgaaatgtgaaaaatccatattagaagtgtccagttgggtttaaagatatgaatctagaattcaggagagagaggtctggagatatgcatttgaaaatcatctgaagatggatgatattaaaacaattaagagatcatcctccaacaagactgtaggaagagacgagaagaaacctttgtcattttatgtaatacacatttaaaggttgaacaaagaaggagaaagaaggcagtgagggagattgtgagaaagcagaggtgaggaggagggaaaagaaaatgtaacctataggaagtcatgaaggaaaagagtattaaggagtgttagtcaatagtgtcagatgttagagtcaaggacagctaattgaggcacaaccgattgtaatatgattagagaataggaggtaggttgagaggaattggcaaatgactgactttgggtgggggcaagttaaagctgccattcctatttctagcagaggtgagtgggaggacaatgatgatgtatgagctaaggaacactgtggaatagtgtggctgagttggaatataatgagtttgatttgggacatgatgagctgaagaatattcttccagcccttgattttgtgtgtgtgtgtatatgtacatataaataaaattccttgtttagaaagcaggaagtaagaaatgaactctgttctcttttggtattctgattgtcttcataaattagtaactctatatgttatcacctttatgcaaattgtctttaatcaggtcatgttagacaaacttaaaaagatgtgactctacttaagattaagctgcgtacgagtccccagagtccaataaaactcttttatctggaagcatatgaagttaatatttaattctggggttccttctcttttttagagatgcactcaacaaaatgaaagatgtatatgagaagaatccacaaatgggggatccagggagtttgcagcctaaattagcagagaccatgaataacattgaccgcctacgaatggaaatccataagaatgaggtagatttgttattcagcacttgtcaagataaattatttttataaacttcattatgatagattggtttttgttagaattatcttcaaatgtttatatttaatgttagggtttatgatctaaaagtattattgtgatgtgtgttatttaatctcattaaagttttttatttagacctttatataagattaaacatttatactatttttttgaatcagctataaagttgatcctttgaccagtttggaataaaggtttcacatctctaagaattacataattataaaaacttaaacacattttaaatgtagatatcttatgagcttttaaacatatttattgagctcagttgtttgcttattttttttcctaaggcttggctctctgaagtcgaaggcaaaacaggtgggagaggagacagaagacatagcagtgacataaatcatcttgtaacacagggacgagaaaggtgattttttgtattttatttgtatttcttctccccagagttttctcacccttttgtcctaaactttatacaattcgtttttttcttccaaatttaacaagttaagcttttagtaacctcagtcttttgaacctaagtaattttctttagtgataattacaggtgaagtaggaaagttcatcttgctattcaatcctagtttgtcatgcatccaaacacagagctaggaacatagaaaattcttggagctacagtctgagggcctaggctcctcgggcatgggaaggtttcctaaggttcaagtggaattagggtcgcttatgccaaagaaaaattttactatcaaatagctcagagttttgtgaagaaaaaaaaatgtattgttagtttggaccagagcttccaaaagacactttgctaagtttctgtaccacttgtgacatttctttcttgatgtattatatctttttttccagactaaaagtccacaaattaggattcaccttagagaaaaatgtgagaggcctagtaacaactcttagttttctacttaattacagtgtaatctgagcaagttcatttttaatgctccctaagtctcaatttcctgaaatataaaatggaggttaaaatatccaccctttaggtttgttagtaaaaaagtaaataatacacataaagcacctagtagtaaatagtggtaatagtagtatcacttcttgaaagagtacatatctttaatctgttaagagatacccacaaattactggtttttgttattaggtaaaactcagattaaaaggatctaatttctttggcatgtgttatttctctggcttccaggcttactgaaagtactgttaaaatctaattctgtaaaattttccattattaaatctaattcagtcatttgattcttcagcaaaattattaacatttttctctgatttaaaaaattttaagaaaaataaattgtgtttgtattacctgcttttttggatttttttaagttaccaacttccctgttaccatgattagttggaaatttactttactttttattttagttgagaatcttttaattttcagtgacagaatgaatactttacccatgctggcttaaactaaaaatggacttcattggctgacttcagggagagcttgatctaggagctcagatgttatccctaggactcaatttctctccacctcacagctgtgctttctactgtgttggcttccttttaaggctccaaagctctaggcgagtattcctgcaggtttcgagtccagtagaaaagggacagagtgaattctcttcgaagagtcccaagcaaaagtttctgtgcatttcttaaatctgattaggttacaggacttcttgtgaactggttatatagatgattgctctgatgggccactccagattcagaatagaaacaatccacctgaagcgtgtgaactaaacatggatatgcatggatcccttaaggaattttaggatgataaatttgggatgatggaagacaagggtctagaacgtttttctgttttatgtctagaccgagtgatagtgaggtgtatttactgaataatactttgtgcctagaatattgtaatcttgtaatttttttttaattcaggaaattcagcaaagcagcattttgtattagaagtaatttgtatacttgacatttgaaaaaaatagggcttaagtggaaactgtgtcattaatatttaatttttggaattgatcctgaggtgatcaatttataaataatatatagaattctcatgtttatgatacttgatcagagataattttttgttttatagtcctgagggaagttacactgatgatgcaaaccaggaagtccgtgggccaccccagcagcatggtcaccacaatgagtttgatgatgaatttgaggatgatgatcccttgcctgctattggacactgcaaagctatctacccttttgatggtatgattttcttaataatattgtatgtaaaaaaattggttctttaaaagtatttacatcaagtcactcactgtagtatccttatttaagtaatatatgttgtcagaaaattattatcccatttctttagtatgcatacttttgttataactgtattacaaatgtagatatttttcttccgtacatggaattaaaaggaaattgcccacgttactagcatcctaatacagattattaattaattatcaattttggtcagtgcagaattttcaccagagtccttactgtgcacatgtcctaaacaaagtcgaggcagcttgaacatgtagctcaacccaggaagcgggatgctggcggatgccacttcatgctcttccttgtagcttactaacattaagagacaggtacaaggcatagctagctgaatgccatcatcatatactgagtccgtaggccacctgtttagatgaaagtgggagagaatgtagtagctactgactatgttatctcttactctatgaaagttgaagaacaaactctggaagggaagtaaggcactgaggccttctcctgcagatttttagttcctctttatcctggactgtgaaaaatactttccctcaactaacaggagaactgagcgacactttcataaataaacggttgtaaaatggtgcttgatttaaggtctttctccccacttcgtgttggtttaaaattgagcaaagtctctagttacttcttattagaaaatatattaaatttaagaccttgcagccaagtgcagtgatgtgtgcctatagtcccagacacttgggaggctgcggtgagaggattgcttgagcccaggagttcgaatccaacctgggcagtaagaccctatctctaaaacaaaacaaaagaaaacaaacttgctataatgtaatctagagagtagggaagcaatttggcacgtgttaaatgaagattcagttgtgaaaattgttactgctaagcaggttgggcgtggttggggatagagagtgaaagagttgtgtatggccattctgtttctaccatctctagagtcaaacccgtatttttctctgttctcccttcagactctcttttttccttctttcttcctgctcttttgctatctggttactgttttcctaatccatacctgctgaatttttttagatagactactaaaatttgggaaaagagttggaatagtgacataggaattagaataccctgtcaaatcatgtaatgtcactgtgactcagttaacttcatccgttacatgggggtgatgttatccagccctgcgggcttattatgcagctcaaatgagagaatgtatatgaaagtgctgggtaagccacaaagcacaatagagatgttgctagtgagagtcagtagttccaggtacattgaaatctagtagggtttcattgtattttgtgcattgtattagtaactttaaaaaaaattatcacaatgcttaaattatgcttgtgaaaactctcatctaggacataatgaaggtactctagcaatgaaagaaggtgaagttctctacattatagaggaggacaaaggtgacggatggacaagagctcggagacagaacggtgaagaaggctacgttcccacgtcatacatagatgtaactctagagaaaaacagtaaaggtgcagtaacttatatctaaactaaccaggcacctttgtgccatgtgtgacataggaagagtaacataaaatgaaaacacattcaacaggttgaaaaaaataaggaaacttaaagggcatccaagattaattgttcactatgtgagctgagtgtaggcttgatcttgtgaatattaccacaagaaacattttgtggcactttactgtttgagtaacgttggtgtgaagcttaattgatgccttttgctttatgtcccgcttaagtctgtgtgaaggatttgtgtttttctgccttacaaatagaatttgatttattgggcaggaattcatggatagtaatgctctctgccccctttacttcagaaaacacagtgactttagtgaatttgaatagtgaaactgctctgaaatgctatggaaagccgactccccaaagagtggtttcttctagaagtttgaatttgtagctacagtttccaagaagaaaaatagtagttggataatttagtaaaataataacatcattttcattttcttacctattcttaactttggtttcctaaaggaagaaaatgagcaggtagcacataatctatttaagtagatttaaagagagtttcaaaataaatctcctggtctagctcttaggtgaataaaatagattttgtttgagacctcaaaatattttgaggttagctggtaattttcaataatttacaagcttccttccaaactaatctcatacttttgtatgtttcatcttgaaaatatcttttgggaaataccactttagtgattatttagcatttagcagttacacataggaaaatacacagttacatagaaaaatacacatttgaagatagaggaaaccttgaatggaggggaagtgttgacaaattttaatttttaaaggagaaactttttgactatctgggttagaggaagatatgtgtaccgcctttagggcattttgttatttccgctgaatcattagttattaggatagataaatttttccaattagtttcagcaagcgttgttggaaacactgtgcagtcaaggattgtgcagtgctggttgtgtgaccacaccctgagtcagtggtgtggggaagtaaagtgtgaagaagcagtaagattggtttttaattttgcccatgttttaaattttcctggtgttttcggtagctgactataaaatgatagagacatttgggacaggcactttaaactgaacaccccttttggttttaccaaaggtcttcagtaattgttcttttctttttcctcctggactgcaggttcctgaagagggtttctgaggaaatgggcaagatgttgaaggaggttacatgcagctgcttttgggggagggtattagagttgtcaggctcaaagagagtgagagaagcaagttgcatgagtgcatgcagacatgattttttttttactaacttcattagcatttccatacattgtttttaaaaatcataataccaacccttaagttcctagttcacagttattcccacaaaagaaaaagccaacaatagtgtaccatttttctatttattttattgctgtctaatcaataaagaatgcagagctgtcaaaaaatgtgtcttacattagctgtcccaacaggattgtcttccctcccagctctgttttaattggcttttagacccactatctgtcagatccttgccatctgtcagtgtctgcctgcgccacctccgtgcttgcttaacatcctgttgcatgtctagcgtgattgagctagatttttcaggcatgtctttagattcccttgttcttgtcaaagccttgttttgttttacatttgtagtgcaaatcactttgtcaaacatctccagcactaatgtttccatcttagtatttgtgcacactgctataacttccccactgcaaacattccagttttggcattacgaagaagtagctgtgaacctgaagtatttatgataagaaaaagaaaacatctctgctgtagcctacagcccagttgaaagaactctttgaaacgtgatacatcttcagcacctcagtctgggaagaatctagtcagcactgaaatcctggcataataaacacagaagatattcaccacctcaagacaaaggactattgtcaaaagtcagctgcttccattcaaatgctgccttaaacttgagtgcctaaatctgttgattgccaacactaccactacagtatcccacaaagggctttatgtgtcagctcagtgcgacctgctttaactctgcagcaccgctgcagctgccgatgtagcctcggtaggtggctattagagctctaccatatacagtggtgcatcttcaaatttatgcatcaaactaaagacatgtccaagtccattttaatttcctcagtggttttatgagaagttttatgggcctcccccaattgtctttttattttgggttatgacgatcatgtttgataattacaatgatagtctctttccacgtgatgcttttgtttgaacctgataaaatttagtgaaactttgtaatgatctatgtgcacttttacttgtaaaatggaatttctgtatgtttatacttgtaaatatgattgttgttagtgctcctgttgctcatggtgtcctgcctcgcatttgtgattctgttaatgacatgtatcttaactaatttcttagtggtgttgtaatagggagatggggcaggtggggggttatttgtaccactgaatcttcattaatttggttctttactgttttgaggggagaaagaacgtgaaatggtttgtgtattattgaattttaagcaatattttagaagctgtgtgactgctttaataactttttcccagtgttatttgaatcatactacccgttatactaaagctgaatgacaattgtgtgaaagttactgccttcataagatcaagtcaccactgttacacagctgacatatagtgtattacctttgcagctagtaaactataaagtttagatattgaatctcgttacagggttatttatataatgtgacattattcagtactgacagactacatgaagtagttttaaaatctagtgctatttttattttaaaggttagcaatgaggaggaaatgtgatctggctgtgtttgtcttctgtacaaagcctgaagtgcttatggttttttggctaacagccacagagggcaaagtttaagactttcttgtaaggactaactgttcttttcaagctactgtttgtttttctaaaagcaggatttgcttccgtaggaggcaagttccttgatgtggaatagtgcaacctgtatatgggttattataataggaaagacatttgtacttgcacagtttaaatcattcttaaattttgaacatgtgaattgtcccaaaaaatctttaattttttggtaatttttactctttttgtgcacatgttgatttcttaatggtaaatccttcatttaaagatagtgttctctgttgagaatatttacatggaataaaacaatcttttcatggcctgttaaggtgtttagtgtgtgatctttcattgctatgtgaatcagagatgtgatgattttgttcttgaatgtgccaagtctcagataatacagagtagatgacaaattc

SEQ ID NO: 13158 - DNA, 3304 bp, Homo sapiens
tacttcagaaaacacagtgactttagtgaatttgaatagtgaaactgctctgaaatgctatggaaagccgactccccaaagagtggtttcttctagaagtttgaatttgtagctacagtttccaagaagaaaaatagtagttggataatttagtaaaataataacatcattttcattttcttacctattcttaactttggtttcctaaaggaagaaaatgagcaggtagcacataatctatttaagtagatttaaagagagtttcaaaataaatctcctggtctagctcttaggtgaataaaatagattttgtttgagacctcaaaatattttgaggttagctggtaattttcaataatttacaagcttccttccaaactaatctcatacttttgtatgtttcatcttgaaaatatcttttgggaaataccactttagtgattatttagcatttagcagttacacataggaaaatacacagttacatagaaaaatacacatttgaagatagaggaaaccttgaatggaggggaagtgttgacaaattttaatttttaaaggagaaactttttgactatctgggttagaggaagatatgtgtaccgcctttagggcattttgttatttccgctgaatcattagttattaggatagataaatttttccaattagtttcagcaagcgttgttggaaacactgtgcagtcaaggattgtgcagtgctggttgtgtgaccacaccctgagtcagtggtgtggggaagtaaagtgtgaagaagcagtaagattggtttttaattttgcccatgttttaaattttcctggtgttttcggtagctgactataaaatgatagagacatttgggacaggcactttaaactgaacaccccttttggttttaccaaaggtcttcagtaattgttcttttctttttcctcctggactgcaggttcctgaagagggtttctgaggaaatgggcaagatgttgaaggaggttacatgcagctgcttttgggggagggtattagagttgtcaggctcaaagagagtgagagaagcaagttgcatgagtgcatgcagacatgattttttttttactaacttcattagcatttccatacattgtttttaaaaatcataataccaacccttaagttcctagttcacagttattcccacaaaagaaaaagccaacaatagtgtaccatttttctatttattttattgctgtctaatcaataaagaatgcagagctgtcaaaaaatgtgtcttacattagctgtcccaacaggattgtcttccctcccagctctgttttaattggcttttagacccactatctgtcagatccttgccatctgtcagtgtctgcctgcgccacctccgtgcttgcttaacatcctgttgcatgtctagcgtgattgagctagatttttcaggcatgtctttagattcccttgttcttgtcaaagccttgttttgttttacatttgtagtgcaaatcactttgtcaaacatctccagcactaatgtttccatcttagtatttgtgcacactgctataacttccccactgcaaacattccagttttggcattacgaagaagtagctgtgaacctgaagtatttatgataagaaaaagaaaacatctctgctgtagcctacagcccagttgaaagaactctttgaaacgtgatacatcttcagcacctcagtctgggaagaatctagtcagcactgaaatcctggcataataaacacagaagatattcaccacctcaagacaaaggactattgtcaaaagtcagctgcttccattcaaatgctgccttaaacttgagtgcctaaatctgttgattgccaacactaccactacagtatcccacaaagggctttatgtgtcagctcagtgcgacctgctttaactctgcagcaccgctgcagctgccgatgtagcctcggtaggtggctattagagctctaccatatacagtggtgcatcttcaaatttatgcatcaaactaaagacatgtccaagtccattttaatttcctcagtggttttatgagaagttttatgggcctcccccaattgtctttttattttgggttatgacgatcatgtttgataattacaatgatagtctctttccacgtgatgcttttgtttgaacctgataaaatttagtgaaactttgtaatgatctatgtgcacttttacttgtaaaatggaatttctgtatgtttatacttgtaaatatgattgttgttagtgctcctgttgctcatggtgtcctgcctcgcatttgtgattctgttaatgacatgtatcttaactaatttcttagtggtgttgtaatagggagatggggcaggtggggggttatttgtaccactgaatcttcattaatttggttctttactgttttgaggggagaaagaacgtgaaatggtttgtgtattattgaattttaagcaatattttagaagctgtgtgactgctttaataattttttcccagtgttatttgaatcatactacccgttatactaaagctgaatgacaattgtgtgaaagttactgccttcataagatcaagtcaccactgttacacagctgacatatagtgtattacctttgcagctagtaaactataaagtttagatattgaatctcgttacagggttatttatataatgtgacattattcagtactgacagactacatgaagtagttttaaaatctagtgctatttttattttaaaggttagcaatgaggaggaaatgtgatctggctgtgtttgtcttctgtacaaagcctgaagtgcttatggttttttggctaacagccacagagggcaaagtttaagactttcttgtaaggactaactgttcttttcaagctactgtttgtttttctaaaagcaggatttgcttccgtaggaggcaagttccttgatgtggaatagtgcaacctgtatatgggttattataataggaaagacatttgtacttgcacagtttaaatcattcttaaattttgaacatgtgaattgtcccaaaaaatctttaattttttggtaatttttactctttttgtgcacatgttgatttcttaatggtaaatccttcatttaaagatagtgttctctgttgagaatatttacatggaataaaacaatcttttcatggcctgttaaggtgtttagtgtgtgatctttcattgctgtgtgaatcagagatgtgatgattttgttcttgaatgtgccaagtctcagataatacagagtagatgacaaattc

SEQ ID NO: 13159 - DNA, 11964 bp, Homo sapiens
aaaagacggagtctcgctcttgtcgcccagcctggagtgcaatggcgcgatcttggctcactgcaacctctgccttccgggttcaagtgattctcctgcctcagcctctcacgagtagctgggattacaggcgcctgccaccacgcctggctaatttattgtatttttagtagagacagggtttcatcatgtcggccaggctccagtctggcctcaaactcctgaccttaggtgatccacccgcctcagcctcccaaagtgttgggattacaggcgtgagccactgcgcctggccttattcttagaataaccattttgaaaagaaaatgaatagtgacaggcatcatcaatttctggagtatatataaagatttaagtaatataggtttatattaaatagattcaatagcggctaatattggttctgttgtaatctgtaatataagtaacagtgattaaaataacatttaagggaaaaggtgtcatttggatcagatgtttacgtttaaatactagtactttttcttaaattgcatagttttttgaatatcaaaactttaaaaaattttcagacatcaaggatctttcctaaagaaggattttatccttctttcagtaacaactgaggtatgttatttggtttacaaaaggttaattgaaaatatacacttgtttgaatataatttctgctcagtggatagttctatctttggtttttaatgaccaggtatgttttgaatggtttaatcagttgttcaaagactatatgtagtgttaaagtatatttcattagattgtctttgtgaggtaagtttcttaattatattcatattttcagtttgaacatttgtaacattctgaatgtcatggcaatgggttttatttggaaatgttgtgatatgttatatataaaacaataccctgtatagacaagaatgttacgtgtttccattttgttgttgttgctgtaagaaggtttacatgtattcattataactctgccaagatttgaaagtaatgtgatactacctaccagttatctgtatctgggtatgattttacttattctgtttcatggttttataaaatgactgaaatttgagctcttttcttcagtacattgttttcattaacatatacgcataaacacacacatctgtgtagatttcttttttttttaaggggttgcttgaggcaaatttgaaattaaacttaagattggtatgtattcttattttatagcaggtatattttaaaaataaaatttcccgaaaatgtctattataatgatttagattctcttttcagggcccagcactagaagatttcagtcatctgccaccagaacagagacgtaaaaaactacagcagcgcattgatgaacttaacagagaactacagaaagaatcagaccaaaagtattattcctttaagttttctctatcattattattttaggatctactttgagtgacgcccttaaatgtgatatacagaaggtttaaaaatcatatatcctaattgaaatatcttttgagagagaattatactcctaccctggaaatttttatggttaccctgtcataggttagagaatttccttggttgcagatttttattgaatgctaatatgccttcattaatttgcaaaaaatttcttgatattttattatcaagagtagtttcatcagcactacctcttatactttgatatattttcattttgcttttatatataaattgatttcattagcaacctgaggctattttgtagcaaaacatttggcaaacggtgcttgattactgacggcttcatatttgttcacacataagtttacttttttatttcatttttataagacgtttcctctagtttaattttttaaaaatagacatagaagaattattcacgatcattaaagtgttattacaatgaattggtgacttgctatgtcttcacttacgataaaattggggcttaaattgtagcatgagagattgaagttttgatgctaagaattagtgtatcaggtgtgatgtggcgcttaatcataatgaaatatttgcactacctttgattctcattcacagtagctgtgttctgtaaagtcactgtgaacactaaattatggaatactgaaacattgctcttagggagatacagggttaggttctaggtagccactggtcacaatgtttcagtcagctgattggcacataacctttttttatttgtgtttctgtgtaaaaacaccttatttcatatatgatgttgatttattaactttgatttttttctaatagcactgtaactcatgcttgaacaaagcttatctaagattagaattttctctgtaaggtacagccttcttgtgcttcagaacactagacagcacttgattgccatgcttaggggctattttaaacaccaatatcaacaaaaagcataaaaatatgaggaacattgcactaaatgagtagattgcaaaaaggatacatgtccagaatatgagaatacgagcaagaaggccagagtgtcactggtttgaccacagtttagaacttgaatgtacctctggtgactcaaattttcccagatatctccatgtccaaaacaagagtaaaggcacagaaatgtgaatgttcttgccatggactggaattagtgctaatccagagagacttggttaaaaattatgtggaacataataatagaagttgaggatgaagaagtataggacttgtgaaaaattctgaatgcttttctgtgaagttctgtaggtactacagtccccagttattgagagaaggggtaacattattagctctgtgtgataaaagataattgaaaactgtatgaagagtaaatagtataggaaagagattggaggtagaagcctttaacaatccaggtgagagatactgagggcctaaattaaggcatgaccatgggaatagaaaggaggaatagataaaagaatcatttcaaagccaaagtaggttgtactttcacctgattggatgctggagaagagaaaacatggaggaagcttaaaaaaaaaaaaagatttgtagctatagatttaattgcaacaataagaaaaaagtttagggcaaagataaagattttgtttatgttgatttttgaaatgtgaaaaatccatattagaagtgtccagttgggtttaaagatatgaatctagaattcaggagagagaggtctggagatatgcatttgaaaatcatctgaagatggatgatattaaaacaattaagagatcatcctccaacaagactgtaggaagagacgagaagaaacctttgtcattttatgtaatacacatttaaaggttgaacaaagaaggagaaagaaggcagtgagggagattgtgagaaagcagaggtgaggaggagggaaaagaaaatgtaacctataggaagtcatgaaggaaaagagtattaaggagtgttagtcaatagtgtcagatgttagagtcaaggacagctaattgaggcacaaccgattgtaatatgattagagaataggaggtaggttgagaggaattggcaaatgactgactttgggtgggggcaagttaaagctgccattcctatttctagcagaggtgagtgggaggacaatgatgatgtatgagctaaggaacactgtggaatagtgtggctgagttggaatataatgagtttgatttgggacatgatgagctgaagaatattcttccagcccttgattttgtgtgtgtgtgtatatgtacatataaataaaattccttgtttagaaagcaggaagtaagaaatgaactctgttctcttttggtattctgattgtcttcataaattagtaactctatatgttatcacctttatgcaaattgtctttaatcaggtcatgttagacaaacttaaaaagatatgactctacttaagattaagctgcgtacgagtccccagagtccaataaaactcttttatctggaagcatatgaagttaatatttaattctgtggttccttctcttttttagagatgcactcaacaaaatgaaagatgtatatgagaagaatccacaaatgggggatccagggagtttgcagcctaaattagcagagaccatgaataacattgaccgcctacgaatggaaatccataagaatgaggtagatttgttattcagcacttgtcaagataaattatttttataaacttcattatgatagattggtttttgttagaattatcttcaaatgtttatatttaatgttagggtttatgatctaaaagtattattgtgatgtgtgttatttaatctcattaaagttttttatttagacctttatataagattaaacatttatactatttttttgaatcagctataaagttgatcctttgaccagtttggaataaaggtttcacatctctaagaattacataattataaaaacttaaacacattttaaatgtagatatcttatgagcttttaaacatatttattgagctcagttgtttgcttattttttttcctaaggcttggctctctgaagtcgaaggcaaaacaggtgggagaggagacagaagacatagcagtgacataaatcatcttgtaacacagggacgagaaaggtgattttttgtattttatttgtatttcttctccccagagttttctcacccttttgtcctaaactttatacaattcgtttttttcttccaaatttaacaagttaagcttttagtaacctcagtcttttgaacctaagtaattttctttagtgataattacaggtgaagtaggaaagttcatcttgctattcaatcctagtttgtcatgcatccaaacacagagctaggaacatagaaaattcttggagctacagtctgagggcctaggctcctcgggcatgggaaggtttcctaaggttcaagtggaattagggtcgcttatgccaaagaaaaattttactatcaaatagctcagagttttgtgaagaaaaaaaaatgtattgttagtttggaccagagcttccaaaagacactttgctaagtttctgtaccacttgtgacatttctttcttgatgtattatatctttttttccagactaaaagtccacaaattaggattcaccttagagaaaaatgtgagaggcctagtaacaactcttagttttctacttaattacagtgtaatctgagcaagttcatttttaatgctccctaagtctcaatttcctgaaatataaaatggaggttaaaatatccaccctttaggtttgttagtaaaaaagtaaataatacacataaagcacctagtagtaaatagtggtaatagtagtatcacttcttgaaagagtacatatctttaatctgttaagagatacccacaaattactggtttttgttattaggtaaaactcagattaaaaggatctaatttctttggcatgtgttatttctctggcttccaggcttactgaaagtactgttaaaatctaattctgtaaaattttccattattaaatctaattcagtcatttgattcttcagcaaaattattaacatttttctctgatttaaaaaattttaagaaaaataaattgtgtttgtattacctgcttttttggatttttttaagttaccaacttccctgttaccatgattagttggaaatttactttactttttattttagttgagaatcttttaattttcagtgacagaatgaatactttacccatgctggcttaaactaaaaatggacttcattggctgacttcagggagagcttgatctaggagctcagatgttatccctaggactcaatttctctccacctcacagctgtgctttctactgtgttggcttccttttaaggctccaaagctctaggcgagtattcctgcaggtttcgagtccagtagaaaagggacagagtgaattctcttccaagagtcccaagcaaaagtttctgtgcatttcttaaatctgattaggttacaggacttcttgtgaactggttatatagatgattgctctgatgggccactccagattcagaatagaaacaatccacctgaagcgtgtgaactaaacatggatatgcatggatcccttaaggaattttaggatgataaatttgggatgatggaagacaagggtctagaacgtttttctgttttatgtctagacccagtgatagtgaggtgtatttactgaataatactttgtgcctagaatattgtaatcttgtaatttttttttaattcaggaaattcagcaaagcagcattttgtattagaagtaatttgtatacttgacatttgaaaaaaacagggcttaagtggaaactgtgtcattaatatttaatttttggaattgatcctgaggtgatcaatttataaataatatatagaattctcatgtttatgatacttgatcagagataattttttgttttatagtcctgagggaagttacactgatgatgcaaaccaggaagtccgtgggccaccccagcagcatggtcaccacaatgagtttgatgatgaatttgaggatgatgatcccttgcctgctattggacactgcaaagctatctacccttttgatggtatgattttcttaataatattgtatgtaaaaaaattggttctttaaaagtatttacatcaagtcactcactgtagtatccttatttaagtaatatatgttgtcagaaaattattatcccatttctttagtatgcatacttttgttataactgtattacaaatgtagatatttttcttccgtacatggaattaaaaggaaattgcccacgttactagcatcctaatacagattattaattaattatcaattttggtcagtgcagaattttcaccagagtccttactgtgcacatgtcctaaacaaagtcgaggcagcttgaacatgtagctcaacccaggaagcgggatgctggcggatgccacttcatgctcttccttgtagcttactaacattaagagacaggtacaaggcatagctagctgaatgccatcatcatatactgagtccgtaggccacctgtttagatgaaagtgggagagaatgtagtagctactgactatgttatctcttactctatgaaagttgaagaacaaactctggaagggaagtaaggcactgaggccttctcctgcagatttttagttcctctttatcctggactgtgaaaaatactttccctcaactaacaggagaactgagcgacactttcataaataaacggttgtaaaatggtgcttgatttaaggtctttctccccacttcgtgttggtttaaaattgagcaaagtctctagttacttcttattagaaaatatattaaatttaagaccttgcagccaagtgcagtgatgtgtgcctatagtcccagacacttgggaggctgcggtgagaggattgcttgagcccaggagttcgaatccaacctgggcagtaagaccctatctctaaaacaaaacaaaagaaaacaaacttgctataatgtaatctagagagtagggaagcccctggcacgtgttaaatgaagattcagttgtgaaaattgttactgctaagcaggttgggcgtggttggggatagagagtgaaagagttgtgtatggccattctgtttctaccatctctagagtcaaacccgtatttttctctgttctcccttcagactctcttttttccttctttcttcctgctcttttgctatctggttactgttttcctaatccatacctgctgaatttttttagatagactactaaaatttgggaaaagagttggaatagtgacataggaattagaataccctgtcaaatcatgtaatgtcactgtgactcagttaacttcatccgttacatgggggtgatgttatccagccctgcgggcttattatgcagctcaaatgagagaatgtatatgaaagtgctgggtaagccacaaagcacaatagagatgttgctagtgagagtcagtagttccaggtacattgaaatctagtagggtttcattgtattttgtgcattgtattagtaactttaaaaaaaattatcacaatgcttaaattatgcttgtgaaaactctcatctaggacataatgaaggtactctagcaatgaaagaaggtgaagttctctacattatagaggaggacaaaggtgacggatggacaagagctcggagacagaacggtgaagaaggctacgttcccacgtcatacatagatgtaactctagagaaaaacagtaaaggtgcagtaacttatatctaaactaaccaggcacctttgtgccatgtgtgacataggaagagtaacataaaatgaaaacacattcaacaggttgaaaaaaataaggaaacttaaagggcatccaagattaattgttcactatgtgagctgagtgtaggcttgatcttgtgaatattaccacaagaaacattttgtggcactttactgtttgagtaacgttggtgtgaagcttaattgatgccttttgctttatgtcccgcttaagtctgtgtgaaggatttgtgtttttctgccttacaaatagaatttgatttattgggcaggaattcatggatagtaatgctctctgccccctttacttcagaaaacacagtgactttagtgaatttgaatagtgaaactgctctgaaatgctatggaaagccgactccccaaagagtggtttcttctagaagtttgaatttgtagctacagtttccaagaagaaaaatagtagttggataatttagtaaaataataacatcattttcattttcttacctattcttaactttggtttcctaaaggaagaaaatgagcaggtagcacataatctatttaagtagatttaaagagagtttcaaaataaatctcctggtctagctcttaggtgaataaaatagattttgtttgagacctcaaaatattttgaggttagctggtaattttcaataatttacaagcttccttccaaactaatctcatacttttgtatgtttcatcttgaaaatatcttttgggaaataccactttagtgattatttagcatttagcagttacacataggaaaatacacagttacatagaaaaatacacatttgaagatagaggaaaccttgaatggaggggaagtgttgacaaattttaatttttaaaggagaaactttttgactatctgggttagaggaagatatgtgtaccgcctttagggcattttgttatttccgctgaatcattagttattaggatagataaatttttccaattagtttcagcaagcgttgttggaaacactgtgcagtcaaggattgtgcagtgctggttgtgtgaccacaccctgagtcagtggtgtggggaagtaaagtgtgaagaagcagtaagattggtttttaattttgcccatgttttaaattttcctggtgttttcggtagctgactataaaatgatagagacatttgggacaggcactttaaactgaacaccccttttggttttaccaaaggtcttcagtaattgttcttttctttttcctcctggactgcaggttcctgaagagggtttctgaggaaatgggcaagatgttgaaggaggttacatgcagctgcttttgggggagggtattagagttgtcaggctcaaagagagtgagagaagcaagttgcatgagtgcatgcagacatgattttttttttactaacttcattagcatttccatacattgtttttaaaaatcataataccaacccttaagttcctagttcacagttattcccacaaaagaaaaagccaacaatagtgtaccatttttctatttattttattgctgtctaatcaataaagaatgcagagctgtcaaaaaatgtgtcttacattagctgtcccaacaggattgtcttccctcccagctctgttttaattggcttttagacccactatctgtcagatccttgccatctgtcagtgtctgcctgcgccacctccgtgcttgcttaacatcctgttgcatgtctagcgtgattgagctagatttttcaggcatgtctttagattcccttgttcttgtcaaagccttgttttgttttacatttgtagtgcaaatcactttgtcaaacatctccagcactaatgtttccatcttagtatttgtgcacactgctataacttccccactgcaaacattccagttttggcattacgaagaagtagctgtgaacctgaagtatttatgataagaaaaagaaaacatctctgctgtagcctacagcccagttgaaagaactctttgaaacgtgatacatcttcagcacctcagtctgggaagaatctagtcagcactgaaatcctggcataataaacacagaagatattcaccacctcaagacaaaggactattgtcaaaagtcagctgcttccattcaaatgctgccttaaacttgagtgcctaaatctgttgattgccaacactaccactacagtatcccacaaagggctttatgtgtcagctcagtgcgacctgctttaactctgcagcaccgctgcagctgccgatgtagcctcggtaggtggctattagagctctaccatatacagtggtgcatcttcaaatttatgcatcaaactaaagacatgtccaagtccattttaatttcctcagtggttttatgagaagttttatgggcctcccccaattgtctttttattttgggttatgacgatcatgtttgataattacaatgatagtctctttccacgtgatgcttttgtttgaacctgataaaatttagtgaaactttgtaatgatctatgtgcacttttacttgtaaaatggaatttctgtatgtttatacttgtaaatatgattgttgttagtgctcctgttgctcatggtgtcctgcctcgcatttgtgattctgttaatgacatgtatcttaactaatttcttagtggtgttgtaatagggagatggggcaggtggggggttatttgtaccactgaatcttcattaatttggttctttactgttttgaggggagaaagaacgtgaaatggtttgtgtattattgaattttaagcaatattttagaagctgtgtgactgctttaataattttttcccagtgttatttgaatcatactacccgttatactaaagctgaatgacaattgtgtgaaagttactgccttcataagatcaagtcaccactgttacacagctgacatatagtgtattacctttgcagctagtaaactataaagtttagatattgaatctcgttacagggttatttatataatgtgacattattcagtactgacagactacatgaagtagttttaaaatctagtgctatttttattttaaaggttagcaatgaggaggaaatgtgatctggctgtgtttgtcttctgtacaaagcctgaagtgcttatggttttttggctaacagccacagagggcaaagtttaagactttcttgtaaggactaactgttcttttcaagctactgtttgtttttctaaaagcaggatttgcttccgtaggaggcaagttccttgatgtggaatagtgcaacctgtatatgggttattataataggaaagacatttgtacttgcacagtttaaatcattcttaaattttgaacatgtgaattgtcccaaaaaatctttaattttttggtaatttttactctttttgtgcacatgttgatttcttaatggtaaatccttcatttaaagatagtgttctctgttgagaatatttacatggaataaaacaatcttttcatggcctgttaaggtgtttagtgtgtgatctttcattgctgtgtgaatcagagatgtgatgattttgttcttgaatgtgccaagtctcagataatacagagtagatgacaaattc

SEQ ID NO: 13160 - DNA, 400 bp, Homo sapiens
tccccaacaccttctcttaaaacatgtgatttagaaaatagggaaaagtaaaaattttacaggcagctcactaattgagatgaatgtgaagattaactttataaagctccgttgcattttctgggtcaccgtgtgtgtgtatgtgtgtgggtgtgtagttgggatgctagatagatgccatgccagttgcagaatcctattgacccacagaatgtgggagatatatccaaatccatatacatatctatatctgtacacacacacatatatatacatatataaagtattgttgtacaagagcactatggttggtctcttcagaatctgtgtcatttcatattttcagaaagaatacattttaatcaattttctaaaaattgaagttatgtttttagtgttg

SEQ ID NO: 13161 - DNA, 459 bp, Homo sapiens
aaaactaagatcagtgaaatcacttcctatttgcgaggggaagataacgtccttgataacaacaaatgaaaagtctctctagtctcattgaaaagggttttattttgaagaatgtacaggttaagtattccttatctgaaatgctggggaccagaaatatttccgatttttttttttttagatatttgcattacatacttaacagttgagcatccttaatccccaaatccaaaattctccagtcagcatttcctttgagcatcatgtcattgctcaaaaagtttcagattttggagttttgaatttgggatactcaacttgtattagcttaagtaaaaaaaaaaaaaaaaaaaagcttaagaaacaacctatttcaatgagcttatatacctaggatcaatgtattcctgagtatagtcactgtcaggaattagggaaactacagaaaacataagatgc

SEQ ID NO: 13162 - DNA, 458 bp, Homo sapiens
aaaactaagatcagtgaaatcacttcctatttgcgaggggaagataacgtccttgataacaacaaatgaaaagtctctctagtctcattgaaaagggttttattttgaagaatgtacaggttaagtattccttatctgaaatgctggggaccagaaatatttccgattttttttttttttagatatttgcattacatacttaacagttgagcatccttaatccccaaatccaaaattctccagtcagcatttcctttgagcatcatgtcattgctcaaaaagtttcagattttggagttttgaatttgggatactcaacttgtattagcttaagtaaaaaaaaaaaaaaaaaagcttaagaaacaacctatttcaatgagcttatatacctaggatcaatgtattcctgagtatagtcactgtcaggaattagggaaactacagaaaacataagatgc

SEQ ID NO: 13163 - DNA, 459 bp, Homo sapiens
aaaactaagatcagtgaaatcacttcctatttgcgaggggaagataacgtccttgataacaacaaatgaaaagtctctctagtctcattgaaaagggttttattttgaagaatgtacaggttaagtattccttatctgaaatgctggggaccagaaatatttccgattttttttttttttagatatttgcattacatacttaacagttgagcatccttaatccccaaatccaaaattctccagtcagcatttcctttgagcatcatgtcattgctcaaaaagtttcagattttggagttttgaatttgggatactcaacttgtattagcttaagtaaaaaaaaaaaaaaaaaaagcttaagaaacaacctatttcaatgagcttatatacctaggatcaatgtattcctgagtatagtcactgtcaggaattagggaaactacagaaaacataagatgc

SEQ ID NO: 13164 - DNA, 15205 bp, Homo sapiens
ggtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagaggtgtggtttgtatgaatgctgggattcctatagctgcgggacaaatattttagccagatttgtagatgcctgggactcaatagtgagacatgtgaaattgtataggagcctagaggcttctaagatgcatattgaatttgtaaggagacattccaccttctgtgaaactttggttacctagaattagcctttttagatcaaacattactgagggatctctgtaagctacaggctaaaagctggtggtcccactggctaaattatggctgcaaagggtttttggttttcttttttcccatatgatatttttgggaatttttgtttaaatcaagaatatttaatgtaaaaatctgtatttctggcttctcttgaaattaggtaatctgactacactgagtctacagttctagatggcagcatttggctgggtagcatatgtgccctttagatgagcgtgctctgttcagtttgccagagtccccaccactcccattgtaaccctggctcctcctaataagcctttgagtttgtagagcctgctttaggccaaaaatgatggtagaccagcccttatctgggaggaagagagatttcctttagaattttattcctatggaaatttgatttcagcttgtctttttggggcggggagtcgtaattacctcctcatgtttatgtatgggtcctcatttataacaacgtggactgaaacagcctcttgccctgcctgaagtgacacagtcactaaaagtttggagatttggtaaactaaaagaaggcctgattaaaatctgtacttatcacaattttttagtataaaatgaaattttattttagtttgttagtttggcttatataaagatcttataagtgaagtataattttttaaagtaatacattaagatattgctgtgaaaattaaaactctgcgaaagtctatggagtataacagtaaaagccccccttcatcaggccctcctttctttggcaccagctccccagaatgccactgtcactgtgtgctgttagaggcagtgtggatagaggctaaaagctgactcgggagcacactgcatgggtaggagtctcagtgctgccacttgccagctgtatgacctttggcacagtactaagcctctctgttcctcagtttcctcatctgtaaagtagagttgataatgtagccacctcacagggttggtgtgagtattaaatgagttaaactacagaaaggatttataaagtgtttcacaaatagataacaaattatcattttcttcgatttctagtgagattcagtatgttatctctgtttattggccatttatatgtcttttttgattttcttgtccatgtcctttgcccgtttttgatgcatggttttctttgtttcttttagaaacaatttgctctgtaatgggcttagcctgaagtccctcgctgagactgttttgaactttccccttgacaagtcccttctacttcgttgcagcaactgggatgctgagactctcacagaggaccaggtacttcttatcagagtagttgaagaatggaaagtcattgtttctgaagtataactgtttataaaattcgaattctcaaatatagtataagtattggatggagatgccttaaaatagattcattctctggtgatactccagctaactggtctacaataatcacttaaataaaggataagagtcctgcttttgttttatttttgagatggagtctcactctgttgcccaagctggagtgcagtggtacggtcttggctcactgcaacctctgcctcctgggttcaagcaattctcctgcctcagcctcctgagtagctgagattacagatgtgcaccaccatgcctggctaatatttttagattttcagtagagatggggtttcaccacgttggtcaggctggtctcgaacttctgacctcaagtgatccacccacctcaacctccaggtgtgagctaccgagcctggccaagagtcctgattttttttgagcatttactatatgttgggcatttcagaaaaagggattttttttatgaatacaaatgtataatttaaaaaaaatatagtgttataagtgtgtaggagttataacttattttaagaagcagtaagtagttccctgcattacctttccccattcctaatccttcttccttcttctcctcagaggcaaccactttcatttctttctggtaattatcattatacttctaaattacatgcatgcgttattctttcttatttatttatattatcttttgacatcatactgtgggagatacggtttagtactcttgcagctcccctgtccccggacaaatacttctcttccccatcctcccaatttaggtaaatcatcatttttatcaggttaatatacagtatttatattatttatagctgagtcacatagtaaactgcagttacttttatttcccaggattaataattagtattttgtttgcatagtgttccatgtacctattatttccaccccagactccttatcagaactatggatctcctctgggctggttcagacacacgtcaggtcacttacttgtttcattttcccttggagccttctctcctagagccctctatcatctggctcctcccaggacggagtgcactctaggcctgctgcccaactctcatcctggaatttgcatttaccatcagcctggaattcccttcacctttctctttcatagtagatcctctgttttttaaattccatgtcttcttcctttcttgccttggtggagtacattcataacagtttcttgagaaagggagcatgagcagtaaaaaaaaaaaaaaaaaaaaaaaaaaagtcagtaactgtcttttctctcaggtgacttagtttctccacagatgaatcttctagtattctattcaagaagtgtaagtcccactgcctatattccagtcactgagtgggggaaaggtgccagtggttttaacattcaatgtgtaatctctcccttaatccccctttcttcaggtgacattttgtccctcccttcagttttgcctggtattaccaggtccagatcctctgtggtttaaccattatatgatttaaacttttactgtcttttgggctaggggagggatagttgtctggccctgtgctgtaaaggaggagatcagggtgtaagtgttctctatagagatttcaccttatccttctgtttccgcccttgccttcacagatacctggtgtctccattccttatgctttcctggtctctgtggctcaaactcatttgaacttaggctttttgccataccacttgcataggcctagtttcaaccttgcttgccaagtcagttaccacttgttcatccttgagaaatgttaactggtttccaaagtagctacaccattttgtattcccaccagcagtgtatgagggtgtcggggttctgcatccttgctgacatttgttattgtcagtcttttccattagagccatcctagtaggtgtgaagcggtatttcattgtggttttgatttacatttcccttgtgactaatgatgctgggcatctgttcatgtgggtattggccatttgtatatcttccgtggagaaatgtctattcatacatatcctttgcccatgttttaattgggtcatttgttattttatttttgagttttaggaattctttgtatactctagatccttttcagatagatgatctataaagtattttctaccattggttgtttgaagcacaatagtttttaattttgatgagctccagttatcagtttctttttaaaaatctcttcctttaattgcttatgcttttggtgtcatagtcaagaaatcattgcctcacccaaggtcatgatgattggctcctatattttcttctaaaagtcatatagttttagctcttgcatttaagtctgtgatccattttgagttaatttttgtgtgtcttgtgaggtaggggtccacattcactcttttgcatgtggacctccagtcatcctagtaccatttgtttctttatcattagaaaataatgtgttagagggaactctaaagtcttctcattcaagcacacattcttctgtgggaaacagtctgctaatagatatgtagattgttggatctaggtggaaaattttatccaaacttgttttactctaaaagtataaatgatccttactaatagaattattcactggcttggttattaaaggtgaaataatagaattttaaagtccttacactttttgttgggaaaagctattaattttagtttttttaaaattttagttttttttttaaatttaatttaattaatttatttatttattttgagatggagtcccactctgtcgctcaggctggagtgcagtggtgcgatctcagctcactgcaacttctgcctcctgggttcaagccccaggttcaagcgattctcctgcctcagccttccgagtagatgggattacaggcgcgtgccaccgcgcccagctgattttttttatttttagtagagatggggtttccccatgttggctgcgctggtctcaaattcctgacctcaagtgatctacccgcctcagcctcccaaagtgttgggattacaagcgtgagccaccacacccagccgaattttagttttgaccacgctactttttttttttttttttttgagatagagtcctgttctgtctcctaggctggagtgcagtggcacggtctcagctcactgcaatcttcgtctcctgggttcaagcgattctcctgccttaggcctcctgagtagctgggattacaggcgtccaccaccacacccagctaatttttgtatttttagtagagacagggtttcaccatgttggccaggctggtttcgaactcctgacctcaggtgatctgttcgccttggcctcctaaagtgctgggattacaggtgtgagccaccatacctggcccacagtacttttctttatgaccagcttgcctatcaccagttgcttaggagaatgacttaccactattaaataagtaaattccaggaatgggccctgtgactttgatttgaggcccatgtttgaaacctatttgttttttttgttttcaatatcatattaatagatatggcagttcatttctgattgacagtcacacaggcctcttaatgaatcatgatttcagccattccagaggatgactgcctccaaagtgaatttcatgtactagttatcaggcctttgttaactacccttcccccaaacttgagagaaatctgtccagcaatttggtagtagatagaaacttcactgatttatataggtgaggattttccagcatttagagtaagtcattattttagctattttagttaaaaacatagggaacatgagagttaatcatactattcaatttacttttgtgtagtttgaaaatttttataataagaagttttaaggaagtgtatggtgcccaggttgtcgtacattttgaattaggatcctaagagttatctatttctttgtgattgactttgaagtttttctctctggtttgccttccagattccactgatctctgacttttctcttcaggtaatttatgctgccagggatgcccagatttcagtggctctctttcttcatcttcttggataccctttctctaggaattcacctggagaaaaaaacgatgaccacagtagctggagaaaagtcttggaaaaatgccagggtgtggtcgacatcccatttcgaagcaaaggaatgagcagattgggagaagaggttaatggggaagcaacagaatctcagcagaagccaagaaataagaagtctaagatggatgggatggtgccaggcaaccaccaagggagagaccccagaaaacataaaagaaagcctctgggggtgggctattctgccaggtaactgaatcactccctgtctagtaaagagtcagtggcccagccttagcaaagggtttgatgcttccctggggtctggggagaaggcttgtagtaggggagcagcagctctcccggggttaatcttgctttttctttccatcagagacatttggtctctcctttgctttatttgtgtatttttctccttttcccttattttacctttttatttattgacagttggggtggaaatgaggaaagcttagcttagttctgtcattgaccctgatgtgaccttaggccttaacttctccaactgtaaatggggatataattatcattccttccttgtttcaggctagctgtggaaaataaataacatgtagtgcctcatacttttcaggagaaatgcatcatctgatttcttgttcatatgttatttgattatttagaatgacatccagctccaagaaaatgttactctctagccaatgaaaaatgtcctgtataacttattcctctattgtaggaagatgactaataagtactttggagcataaatttggtccctgtagcaaagtgcctttaggaattaattggatgattaaattgaaggaagtgttactgcatgtgagttagaagtaaatccacatggccctcattactttggcttgaactttaaaatttttaatgtactttgtttaatccagtgatttggcagttttcttgttgcttggttcttttttgcattcacagcagagctgtgtgtaaaccacttgacacactccctaatgtcctagtccataagtgtaaaaactagaggcataaactcattcatttttagttctgtttcctagcccagtgcaggtgaggattaaacatggtttctcactctgttttttccatagtggtgtgtttgaccttagtgttgagaatagttttgagtcactcagaagagagcatgggaaggcaacagacattttgacccacagttagcttccggtttgagatttctctttcctttccctgcagaaaatcacctctttatgataactgctttctccatgctcctgatggacagcccctctgcacttgtgatagaagaaaagctcagtggtacctggacaaaggcattggtggtatgagattcagctgtccttgtttatctctaattaggtgcattggatgctggcaggagtggggagtgagataaggaagagggagggatagaagaaggcagagagaccgtgagatgcatgggactgggtaggcacaacccagaaatcatgttctctgccaggccatagcagagaacagtgaaggtagtgctgcttcttgggtgtggtggtgggggcagggggagcagtcaaacactgatgtctcttctcttaagagctggtgagtgaagagccctttgtggtgaagctacggtttgaacctgcaggaaggcccgaatctcctggagactattacttgatggttaaagagaacctgtgtgtagtgtgtggcaagagagactcctacattcggtgagtgcagcattgggccaccctggttgtctgtggcagatggaaattgcttttgtagccatatgcagagcctttgggggctgtggctgagtctgtccactttggctgagaggcttgttcctagtatccagcttccccaagagctttggtattctgccgcccttgctatagtggcccttacccctcctgagccgtttctcagtttctggagtgcaacaccatactcagtaatggtctgtcatggggacagtggttcccttttgctcatgaaagactgaagaccagttccttcagaagctgtgtccctctcatcctctcttgactggctgaccagctttttgagccatggttttattcatggagtatccagatgtcctgaagcctgctctgtgttgtaatactgtttcacatcagggcccctgcactgtgagggtgaggctgccgactacgtctgagtgcccagacacttgggctttctccctggcttctgtggagtcactcactttcctcctttctcccctgcaaagtgagacaaagtcattgctgccaagagtttttcctgagagcttagttctccttagaaaataatgatgaacctggtgaaccagggaaatagattaaggtattcctcagatgaaggaaattggctttttcaggttcctaggccttcttgagagagttgttttccagttgtcaaaggccattagagtatcttttcagttctctgagactttcccttctgggagcacagccttctcagaggttgttattaacctgtcactatgctggcccaccactgaagcccacagcaggtggtctgtacttacttgcaggagagaggaagctaagacacagatgggctgagagtggaataggtgatactgcctttctgtgatctgtgttgggcggtggtgcccaaggcttctcagtcatggttaggccccagttagaaccccagtagcctgtctgctgtcttcccatgtgctctgtcatacacttatgagcgctgctttccggctgggcttgttccaggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactcagagagttttataacacagacgtggtcacagaggagatgcttcaagaggctgccagcctggagaccaggtacaaagcacaggaattgtggaatgtaccagggacattaaccctcattacttagtgagaatgcttgccagggagggggcattggctgcttaggcacagtgcctagcctcatgcttcacctagtaggtgtctagtagtttaagataccttggaagtggaatagaacaatctacttgaggagttcctttccataggaaacttgcttttgtgaggtgcctatctttgacctttttaaagatcatacacttaatttcggtcatttttgtgattagcgtgcgagtgcagttgtggtggagctgcatcttacacattctatgcagacgtaaatcctcatgccagcacatgagatgaaataatagtccaataacaccctcgaagttctgaagttccccatgagatacagtacattcacccctcagtatccatgggggattggttccaggacctcccttggatactaaaatccaccaatgcttaagtgcctgatatacaatggcatagtatttgcatatatcctgcacacatcctcctgtatactttaaataacctgtaaattacttataatacctaatacaatgcaaatgctatgtaagtagcttttatattttattgtttatgaagtaatgagaaaaaagtttgtacatgtttggtacagatagtacagatagtttttttttttttttttccaaatagttttgtggtttttttgttttgtttttttgagatagtatatggctctgtcacccaggctggagtgcagtggcactatcttggctcactgtaacttccacctcccaggctcaagtgatcctctcacctcagcctcccaagtagctgggactacaagcatgcaccaccacacccagctaatctttgtattttttgtagagatggggtttcaccaggctgcccaggctggtctcagattcctgacctcaagcaatccacctgccttggaagaactgggattacaggcatgaaccactgtgcctggccccaaatcattttgatctgaggtttgaatccacagatgcagaacccacaaagatggagggccaattctatgtgtggttttgtgtctccgactttatacaggtctgtgagaactgtgactaatgaattcatggttcctatctcacctgcactccagggtatcggctcactgaatggaatgttgagcagaattgctgttactatgtaaattacttttctcttttttccttccttgctttctccctccttctccatgagtacatagttgaattcttgtgacacaatgcagtattctgaaatgagaaatgaatgggcacgtggctcagatggtaagagctctgggctaccatgcgcagttctgcctcccaactgtcactttttccaacaggaccaggagttgaaataagggaactgataagttcacaaaaccttgagcgtgatgctggtttttgttaactgaaaaataaaaaagtaactccaattataagcaaatatttaatttttttagaaaacaaaaatttttttactcttatccattactactgatccattacagatactgcaaatatttattgaacagttatttatagatatactatatcttgcagcaaaccagctaataaacttcacataaattgccttaattgtttctcatgacaacccgacaaagtaggatttagatttcttactggttaactgctactatatcttaaatttaaaaaatctttcagggttttaaaagaattatagaattttatccccataactattttgtgaggttgtagaatagatgttgttttgtaagtagctgggattacaagtgtgtgccaccacacacggctaatttttgtatttttagtagaggcagggtttcacctcgttggtcaggctggtctcgaactcctgacctcaagtgatcctcctgctttggcctcccaaagtgctgggattacaggcatgagccaccacgcccagctgccaatatgttttctaaagcagctaaacctcccctttcggccacagacttttctaacaaattcatcttgctgaattgggtagatgaatgctggacttgtgactgagaagaacagttgtttggagacaggcaagttagtgggaagcgcatgagctaaatattaataataaagtgtctgcagatacccagagacgccaacactgctggggtggcgggtgtcttgggagggaggattgaacatggggtatggatgtagggagaggagagtgtgtgtgggcagggtgcttccttgaggaaggtcatctttattcacaggaggtgaaagcaccattcacacagcatcggagcagttttttaaggactctgcttagttaggaaggagggaggcattcatcttctcatttaatggcaccatttgcacaactgagcaaccatggaagcatttcactgtgaccgaaacacttctcaccactgtggcttggcatctttttgtgagaaaaaaggctctaaagaaatatgctaccttgcatttgacattcagttattaaattgtgttgtgaaaaagtgtaacatgcgggccgatttaacagcctcatataaatactgtgtcccagaatgaacaacttaaaagaggggtgaactggtcactgggtaatcctggaagaaatggaagaccagcattcttcatccattatcagctggatggtagtgcccctctcgtgggagctgaacattatgaagtggccttcctgtcagtagagctcagaaccctcaaataccttctgttgggattgcgagtcgtatgttcagactataaaaagggcagagataagaaagaggatgtttcgaaaacaccaaagtaactaaccctttaggagtccttcaacctccccagttacccttggcgcgcagcatttgaagctgtctgtgaggccatcctgcgcttgtttccctcagacactttgtttttcatgttttggcagaatctccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttaggaggggagaaaaagttcttccaaaggctggagaagtgaacaaggagtcaaatttattttcccaattcaacttcataattatcatttctttggcttcatgctctcccgtaactcatgtggttgggatccatcccatctgggtcacttcagtctacttcacgtacttgaaaaggctttcctttacacttccaggaccaaacagcaacttcctgccacacacttccaccctatcactgggagaaatccttttctggacatgagcctttgacctgggtggggcagaaagaaccacaaactccatctcccaatagaactttgaaattcactcagcttttcctttcatgctgtttgttgcctgcttgttgcactcctcctgccccagaactgcaagatttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagcttaaaaaagaattttatgaccagaatccaacaagagctctattttggaattgtgcccaagttggtgatgtttactctaaaattaataataaaactacttgtaagcacaaggctcactggatgtaaatgtaaaacttcgcgactttataaaactggcattcctaggggaggggctatttatcctacaggtccctgcctcctggcagtgccatggtatgtgtgcatggatataccagacacagtcaccatcggccatcagtagcagcccatgaacccacgtgcacatcctgcatcttgctcttctgacccttcattcccacttgtcttcaggcaggcatttctgggatctaaactagaaatccttgaaaacaaatagtaccagccactttgaggaatgtgcattcactgtagtgggttattatggggtctctgcctcctggctgtgttatgcggagcccaggagtggaggagagccgtggaaatagacagggagaggctggtacttgggttgtggtaatagtcaggcttgccacaagagggcactcatagatttgtttttatattcattcttgagaaaaaagcaactggttactgaacgtaactcatgacttatgtttcaaattttgcatagctgattttaagtcattttgatagctttgcaagaaaaatttttcctttgaaacaagggagtagggctgtttcattttctttccttctaatcctcatgccaagaggtgagaaacacttaaggtcatttaaggtgctagggaaagggttttcccatggagctttctgtgaggcgcagtaaaatagagccagcagcaaagtagaggaaaaagccagactgcgtcacacaagatttctcatccttttcaggagagagtcactgtgtagatttgaatcttttttctttgagtctgctttgaactttagcaggcttttcctaagactgacaattgtcgtcttaaatcagagatttgagggtagacttattttatggcaaatgtctatttttctgatataaaagtaacaatgctcattacagaagaatctaaacaaagaataaaaattagccatcttctctccatctaaaacagagctaaactttgctgatatgtttatgaatttcctttcagtattaaaaagtgcatataaggtgtatatttacacaaaattgaaggtcatacatagatacaggttggtatcctaactttaccctctcactgattaacatggtatcacgagtaacttcctatgtttttaaatctttgaaaatagatttctagtggttctaccttatccatccccacactgttgaaaattttggttgtttcagatacttttattatcaatgatgatgtgataaagtttcttgtatatatctctttggctctatctttggtaatttcttaagaatggaatcttagaattggactgtgaagagggggattcacattgctggggctaagtacaaattgacatcaccttttaggaatgaaatgcttctctttgaccctttagctccagtgtcccagcatagtcactgggcttcataggagtagcagtgagaggacagtgtcacagcaagggcctctctgcatgctccctgatcattgtgtttgcaggttcagcatttcttcttgagtccttcccttcttccaaccttattgcctcatttcccccttgtagtcaatgttttttggaaacactgtttattttaaaataaaaatgtaaaaaaaaggtaaaaaaataaaattttaaattttaaaat

SEQ ID NO: 13165 - DNA, 3119 bp, Homo sapiens
ttgctcttctctttctcttgcttgctctttttctcagacttcttcatttgcttttcactcttaagtaacttgtctgcgttctcattcttcatcttttttttcttctccttctctggtttctcaagcttttcatgctttttagactcctttgcttttttaaggggaacattccccacctgcagctcgtcctccagctgagaggcagtaggccggctgaggtcatacttctcctcatactcattactaagaattttgtcctgggccttctttttgggaggtttctcctttgctggcttgggaggacctggcaccacatttgggtctcggtggccatgttcccgcctgtccatgcggttgtcccggaaacggcctgggccagcagcccttgtgctgggttctgagatggtggtgggaggggcatttgtgaagctctccaagctggtggccttgctgggcctcctggttgtctgtggcctctccctgtgctgatccttccgggatggagggtaaagattctctgaaactgagggtctcctggcagtgatcacctcagtggttgtagggggcctgtgggagggtgagggggtccagggcctctgcgtggtgggaaaggcagtggtggtcataggtcttgcagcaactgttaccgcccgggacgtggaccgagtcactgttgtggctggggcaggaggaagggtggtggctctgggggttgagggaggttggggcaaagctggtgcagtggcggccagttttctcaggaccttcacccgactctctctggttggtgggacttgtgctctccttgggtcctctttcttcttctcgctgcccaggcttggccttcctgctccccctccaccgtcattcccctccgccaccacctggccctctacaccagaggccttacatttctggacaaagcccttctgcctgatcttctcgatcctacggatggggccttggtcgatgacctcgtacatggcttccagcctaacgggatatggatagcgctcctccacctgcagcgtcttcttcagcagcaccatgccaaacttgcccttctccagcttcaggaagctcatcagcttagggatgaggctagggtccaggggctgctccaggatctggccctcgctggtgatccttctcaccttgcctccttcctcacctgcctggtggaagagcacaatctgttggatgtgcctctccgccagctcacagtacacatcgtccttcagcaggctcatcatgaggcggtagtagccttccgaggcatgaggggctgagatgacccatactctgttcttccctgcaaagctggcaaggatgttgggagagctggaccccgaagggaaacgcaacattcttgaccgagctgaggacccctcatctctgatcatctcacgcggagagcccctggctgctggtctttgctcaggtctcacggcggccccattgatgtccgagcgggctggcggctctgttgggcgagctagtctcaacacgggcacactcctccttctctggagaggctgaaggtttggttcctccagagtggatctctcaattccgcgagacctcccagtgtgcctcagaaaccgagctggcctactgctgtccggagaaaccaaaggcactttccgtcctccgtggctgcctctaatagtggcatgggggtggggttctgatccacacactagccacatggccaacagcatagtgaaacggggtcccattctccatgtcattgtgtaatccactttgcgatgcacggaggtcataaaacaaaggggagggggaaaaaagaaagaaaattatttatctggaaacagagctggtcattttctttttctgtatctcagccaaggggaggggaaaaggttggttagagagaaggagggaggtcaggagatggaaaatgggatgagatcctgttactttcaatcccctataatttgttagtgtttaacagagacagttacattaagcaggaaatccaattcagtttcccagtcagcatgcttgtactgtttcaactaatgctctggatgctccaaagaaaatgcaaactagcatattaattatgacaacattcacatttcattccttcaaaataagcaataaagaaacaaataaacagatcaaagacagaaaagattacacacttacatggtggctcatagagatggaatgcagagggttgcaaaagaaatcagaagtttggttcccaggacagtttcctagatgaactacttttcctcccagccctctctctctttaccgagggtgagcaatacaaaaggggtgtgctgcagctccagctttcagagtaccgccacagatccacagcctgtcctgatctgagagctgagccgatgccttttctttctggctgtgtctttttaccttctggacaagtaggatgaggtgaaaggagctgtccttctaagtctttgtatctccatttgtctgcagtttctcctcggtctcgtgtgtctgtgtgtgccagtcccttgtgctgacacaggacgtcccttaaagtccagtcctggcgatttctgaatctcactctttccctctttaaagttccaggatccttcttatctccctttcccccatagtctggcttagtctctttgtttccgggcgtaaaagcactgggattaatatgttttccaggctgagggaaaacacaggaatgtgatgtcgaaaagggactttttttttctttcactgtgcttctctcctccctttatttctccctacctttttcctcctctttttcttcttctttttcttctttctcttgcctggattcagtcccagaaatgttaggactacctcagttttgctccaaaccaaactcaaacaacagcagccactggaaatcaaggaaacttcactaagaatttaacagatcagcaaaacaccgcctccttcccattttagcacgttcagagtggactcagtgaggagtgagaaggctgttctttggggtggggtaaagtttttaaactccacacatcatcataaatcactttagaagaggatgactggtgccttaaccccttccaaaccaagtcatcggggtaacttctcttccagtctgttcttac

SEQ ID NO: 13166 - DNA, 3239 bp, Homo sapiens
cttcgtttgccttcaaaggaccccagcaggtcggccactgacttcttgggactctgcgtgaagtgtttgttggtgggtttctgatagccatcctgttctgttttacctccttttttcttcttgctcttctctttctcttgcttgctctttttctcagacttcttcatttgcttttcactcttaagtaacttgtctgcgttctcattcttcatcttttttttcttctccttctctggtttctcaagcttttcatgctttttagactcctttgcttttttaaggggaacattccccacctgcagctcgtcctccagctgagaggcagtaggccggctgaggtcatacttctcctcatactcattactaagaattttgtcctgggccttctttttgggaggtttctcctttgctggcttgggaggacctggcaccacatttgggtctcggtggccatgttcccgcctgtccatgcggttgtcccggaaacggcctgggccagcagcccttgtgctgggttctgagatggtggtgggaggggcatttgtgaagctctccaagctggtggccttgctgggcctcctggttgtctgtggcctctccctgtgctgatccttccgggatggagggtaaagattctctgaaactgagggtctcctggcagtgatcacctcagtggttgtagggggcctgtgggagggtgagggggtccagggcctctgcgtggtgggaaaggcagtggtggtcataggtcttgcagcaactgttaccgcccgggacgtggaccgagtcactgttgtggctggggcaggaggaagggtggtggctctgggggttgagggaggttggggcaaagctggtgcagtggcggccagttttctcaggaccttcacccgactctctctggttggtgggacttgtgctctccttgggtcctctttcttcttctcgctgcccaggcttggccttcctgctccccctccaccgtcattcccctccgccaccacctggccctctacaccagaggccttacatttctggacaaagcccttctgcctgatcttctcgatcctacggatggggccttggtcgatgacctcgtacatggcttccagcctaacgggatatggatagcgctcctccacctgcagcgtcttcttcagcagcaccatgccaaacttgcccttctccagcttcaggaagctcatcagcttagggatgaggctagggtccaggggctgctccaggatctggccctcgctggtgatccttctcaccttgcctccttcctcacctgcctggtggaagagcacaatctgttggatgtgcctctccgccagctcacagtacacatcgtccttcagcaggctcatcatgaggcggtagtagccttccgaggcatgaggggctgagatgacccatactctgttcttccctgcaaagctggcaaggatgttgggagagctggaccccgaagggaaacgcaacattcttgaccgagctgaggacccctcatctctgatcatctcacgcggagagcccctggctgctggtctttgctcaggtctcacggcggccccattgatgtccgagcgggctggcggctctgttgggcgagctagtctcaacacgggcacactcctccttctctggagaggctgaaggtttggttcctccagagtggatctctcaattccgcgagacctcccagtgtgcctcagaaaccgagctggcctactgctgtccggagaaaccaaaggcactttccgtcctccgtggctgcctctaatagtggcatgggggtggggttctgatccacacactagccacatggccaacagcatagtgaaacggggtcccattctccatgtcattgtgtaatccactttgcgatgcacggaggtcataaaacaaaggggagggggaaaaaagaaagaaaattatttatctggaaacagagctggtcattttctttttctgtatctcagccaaggggaggggaaaaggttggttagagagaaggagggaggtcaggagatggaaaatgggatgagatcctgttactttcaatcccctataatttgttagtgtttaacagagacagttacattaagcaggaaatccaattcagtttcccagtcagcatgcttgtactgtttcaactaatgctctggatgctccaaagaaaatgcaaactagcatattaattatgacaacattcacatttcattccttcaaaataagcaataaagaaacaaataaacagatcaaagacagaaaagattacacacttacatggtggctcatagagatggaatgcagagggttgcaaaagaaatcagaagtttggttcccaggacagtttcctagatgaactacttttcctcccagccctctctctctttaccgagggtgagcaatacaaaaggggtgtgctgcagctccagctttcagagtaccgccacagatccacagcctgtcctgatctgagagctgagccgatgccttttctttctggctgtgtctttttaccttctggacaagtaggatgaggtgaaaggagctgtccttctaagtctttgtatctccatttgtctgcagtttctcctcggtctcgtgtgtctgtgtgtgccagtcccttgtgctgacacaggacgtcccttaaagtccagtcctggcgatttctgaatctcactctttccctctttaaagttccaggatccttcttatctccctttcccccatagtctggcttagtctctttgtttccgggcgtaaaagcactgggattaatatgttttccaggctgagggaaaacacaggaatgtgatgtcgaaaagggactttttttttctttcactgtgcttctctcctccctttatttctccctacctttttcctcctctttttcttcttctttttcttctttctcttgcctggattcagtcccagaaatgttaggactacctcagttttgctccaaaccaaactcaaacaacagcagccactggaaatcaaggaaacttcactaagaatttaacagatcagcaaaacaccgcctccttcccattttagcacgttcagagtggactcagtgaggagtgagaaggctgttctttggggtggggtaaagtttttaaactccacacatcatcataaatcactttagaagaggatgactggtgccttaaccccttccaaaccaagtcatcggggtaacttctcttccagtctgttcttac

SEQ ID NO: 13167 - DNA, 808 bp, Homo sapiens
tggtcttccacatgtactcaagaaaatgtctattcctatggtctctgtgttactctgccaggcaccattgttaatccaagtagctctgccaagaacagtagctataaggaagaagagattgtgcttagtggacagcattcttcaaacatggcatcttttcaacttttttttagtaggctttatttttcagagcatctttaggttcacagcaaaattgagtgaaagtacagagatttcccatttattctttgccccaacacaagcaaaacctcacctgttaccaatatcccccaccagagaggtacatttgttataatcaataaacctacaatgacacattgctatcacccaaagtccatagtttacattagggttcattcactcttcgtgttgtacattctatgggttttgacaaatgtcataacatgtatttataattatagaaatatgtagaagagttttattgctctaaaattcctctgtgctccatccattcatccctttcttctcccagtctcttgaaaccactgctactgttacggtctccatggttttgccttttccagaatgtcatatagttggaatcataccgtaggaagccttttcagattggcttttttcgcttagtaatatgcattttaggtttctccatagcttttcatggctaaatagctcatttccttttagtgctaatattccattgtctggatgtaccatagcttatttatctgcttatttactgatggcatcttggttgcttccaatattttgcagttattaataaagctgctataaacatctgtgtgca

SEQ ID NO: 13168 - DNA, 808 bp, Homo sapiens
tggtcttccacatgtactcaagaaaatgtctattcctatggtctctgtgttactctgccaggcaccattgttaatccaagtagctctgccaagaacagtagctataaggaagaagagattgtgcttagtggacagcattcttcaaacatggcatcttttcaacttttttttactaggctttatttttcagaacatctttaggttcacagcaaaattgagtgaaagtacagagatttcccatttattctttgccccaacacatgcaaaacctcacctgttaccaatatcccccaccagagaggtacatttgttataatcaataaacctacaatgacacattgctatcacccaaagtccatagtttacattagggtttattcactcttcgtgttgtacattctatgggttttgacaaatgtcataacatatatttataattatagaaatatgtagaagagttttattgctctaaaattcctctgtgctccatccattcatccctttcttctcccagtctcttgaaaccactgctactgttacggtctccatggttttgccttttccagaatgtcatatagttggaatcataccgtaggaagccttttcagattggcttttttcgcttagtaatatgcattttaggtttctccatagcttttcatggctaaatagctcatttccttttagtgctaatattccattgtctggatgtaccatagcttatttatctgcttatttactgatggcatcttggttgcttccaatattttgcagttattaataaagctgctataaacatctgtgtgca

SEQ ID NO: 13169 - DNA, 808 bp, Homo sapiens; identical to SEQ ID NO: 13168

SEQ ID NO: 13170 - DNA, 434 bp, Homo sapiens
ttgttcaccactcactcctacagtagccactttctcctagttctcgtggcgatttgttctacacatgtgcaacccagctctataccaaagatttatggagagcctccatgcagacagctgtctccctccatcacatcactcctttctctcttgcccacaaattccagtcacttcaactgtgttgaactctgctctgtcttctagcttgggaagaccaccattttctactggagctctacctcccagggtcaaagtctgaaaaatagtcctaggtagaaggatgaaataatttacataatgcatgtgcctgtgaagcacttagcatgatgtctgcacagagtaaatggccaataaatgttgatttttattatgaaatctgtatttgatacaaattttatctataatattttattaaagaaaaaagttttataaaa

SEQ ID NO: 13171 - DNA, 318 bp, Homo sapiens
caaaattgaagaacttggactccagtgttcaagggcaggaagcatccagcacaggagaaagatgtaggctggcaggctaagccagtctctgttttcacatgtttctgcctgcttagattctagcagtgctggcagctgattcgattgtgcccacccagattaggggtgtgtctgcctttcctagcccactgactcaaatgttaatctcctgtggcaacaccctcaagacacacccaagatcaatactttgtatccttcaatccaatcaagttgaaactcaatattaattatcacatcatagttggccccacttccctt

SEQ ID NO: 13172 - DNA, 318 bp, Homo sapiens
caaaattgaagaacttggactccagtgttcaagggcaggaagcatccagcacaggagaaagatgtaggctggcaggctaagccagtctctgttttcacatgtttctgcctgcttagattctagcagtgctggcagctgattcgattgtgcccacccagattaggggtgtgtctgcctttcctagcccactgactcaaatgttaatctcctgtggcaacaccctcaagacacacccaagatcaatactttgcatccttcaatccaatcaagttgacactcaatattaattatcacatcatagttggccccacttccctt

SEQ ID NO: 13173 - DNA, 434 bp, Homo sapiens
ttgttcaccactcactcctacagtagccactttctcctagttctcgtggcgatttgttctacacatgtgcaacccagctctataccaaagttttatggagagcctccatgcagacaactgtctccctccatcacatcactcctttctctcttgcccacaaattccagtcacttcaactgtgttgaactctgctctgtcttctagcttgggaagaccaccattttctactggagctctacctcccagggtcaaagtctgaaaaatagtcctaggtagaaggatgaaataatttacataatgcatgtgcctgtgaagcacttagcatgatgtctgcacagagtaaatggccaataaatgttgatttttattatgaaatctgtatttgatacaaattttatctataatattttattaaagaaaaaagtcttataaaa

SEQ ID NO: 13174 - DNA, 318 bp, Homo sapiens; identical to SEQ ID NO: 13172

SEQ ID NO: 13175 - DNA, 434 bp, Homo sapiens; identical to SEQ ID NO: 13173

SEQ ID NO: 13176 - DNA, 9903 bp, Homo sapiens; identical to SEQ ID NO: 12728

SEQ ID NO: 13177 - DNA, 9620 bp, Homo sapiens
  misc_feature (6398)..(6398): n equals a,t,g, or c
gtgatggtccctttggttttggtgcctcttccatgagcttcagatcagaactagctatgtggttccaggctgccttggtttaatcccttgtcttgcctacttcacctggctcaagagggaagtccaggaggaagaaatggatgaagtcctggaggactcactagatgaacagtatttgactcattccagctgccatgactcccaccagcttcccagcagcaatgccttcctctttgatgcacaggaaggccccttggctgtggaaatagccagtaagtgctcctttgataagaaaaataaagctccatcaatctctcagtagctcctacattctacatgctcaccacctctgtctaaactgagagatgttattctctgcaggcaggccctaaacattcactttaaaaaactgattaggctgaacacagctctgggatcaactctcaagtacaggtccctggtgggtcaggtaatttgctctgttcctgtcctcacctcagtccctctggtccagaccggcatctgcaagccggtatactcaaagcaggccagaatggagagagtgaagagattatggcagactctctgccactactgccgcgcatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccagggtcaaatgaccctcccacctcagcctcctgagtagctgagaacacagatgcatgccactactcctggctattttttttgcctttttggtagagatgggttcttgcctttttgcccaggctggcctcaaattcctgagctcaagcaattcacccacccctgcctcccaaagtgctgggattacagatgtgagccaccgcacccagccttcctgaaatattcttgataattatagttcctgaacagttttcccaagctgttctagccatcccaagaatgttggcaggcttgtccatatgtttggaggtgcaattataatggttcctgggtttcaagctccagtctccatctcccctcaggtgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttcgtctcagtgttgtaattcaatctaaataaacaacgaggctatctgctggagaaaaggctgaatctaagagcaatgccaccagcatgccctcttcccagaatagctccacgctagccattggagcttctttaggtatataagagccctttaggttggtagcctctctggtgtgtgtatagattaaaaccttgacctatatctcctctcccttacttgaatgtttgactttactttgggggcaaaagtttggattgttaggagactatatgctttgtatactcttctatgcaataaaaagagattatattaattcactcattgagctttcacagtaatataaaccatattaggcttgtcattctgtcagtgatgggtgtaagtttgtggctttaattagtcataccatcttctgacaaaggcatccttatttctctttccaatttcacagtaaggtgcagaagaaggtctttaccatctgttaaagatgttcagggccgggcacggtggcgcacacctataatcccagccctttgtgaggcctaggtgggtggatcacttgaggtcaggagttcaagaccagcctggccaacatgctgaaaccccgtctctactaaaaatgcaaaaattagccaagcatagtggtgcacgcctgtagtctcagccacttgggaggctgaggcatgagaatcctttgaacctgggagacggaggttgcactgagccaagatggtgcctctgcactccagcttgggtgacagaatgagactctgtcaaaaaacaacaacaaaaacaaaatatgttcaggagagatattttgtagagaggaagatattccctagtacctataagtcatctcaaggaggtggtcataccttttctagtgctagaaaagccctactcagagaccttcagtgttttcccacctcctgtcaacctgccttatacttcccatatctccatgtgggaggcatccctgtggagtttgcttagcacttggccatgctttctttgaaaccttaaaagctcttaaaggaagttgccttatgttccctgatgagaagatgaagttggcaaaagaatggtgaaaggcagggatcttgacgagagacccctgactatccctttagtgatcagtatcttcacttcccatctcattccatgtcctggtggaatggctgcagaagatgagatccagagccagtggcagcacctgaaggagacccttttcatcaacaactgcctgtgagaaaagctagaacgtcatcacagcagctttgatgaagaaaatggtaggagaggcccaagtcagcctgcttctggcaatatgtatttttctaaaggcatgtgactggggcagagttttatagatttcaagcactttgacatactttacttcacttattcattacaaatgtcccagctagagaggcagggcagctactatcattcctatttataggtaaataaataggcttaaagatttgccttcatcttagaggtatctacctctaaaatcattcttgtgattcctaagctgtctgctgtcttctgtctgctgctgtacactgcctgctgtctctctgcttcttatgtgattggcattcagtagaacccaggtttctgagcacctcacatagcagaatgagagtctcctctgctgccatcctcatcagcttcccttatgtcttggtgactcttcattctaccaccccaaggtggttctctccaacccccctcctcttagattgttctcacacagaggccatcatttcataacattgtgctgggccagaataaccataagcaggtcccttcccataccaaagcagtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaacgtgtataacttgcataaattgtaattatttcctggaacaggatgcacctctaacctctacaggcaaatcatagattccattgtccagctgtataatgaaaacagagttctcagagaagaataccggagactcccccgacttgcctgaatcaaatttccagaggtaagtggtgaaaggccacaatatgaagtcactctcagatgggtctcttctcttgccacactccactgtagaaataaaagaggacggggaggccagagctgctcaaaaccttataacccacaattctcatagttactctcaacttagagagggctgctttctagacacaccccctccaggcccccagactgccaggctccaggaataagtagctctaagaaatacagtatttcagtgtgagccacaccccactattgcaaattggagaggagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcgccactgcattctagcctaagtgacagagcatgactccatctcaaaaaaaaaaagaaaagaaagacagaaaagatttaagagaacaattattttaattgaatacattttgtcaagattaaatcaactttcccctagaatactgaaagaataagcaatcataatttagattctaagttactggactttgagaaagtgtgaaatccaaaaagatgccatgagccaaaaaagagcaaaagtcctaattttcaaactgatgaaaataaagtactaaataattgaaatcatcgtagttcatcttggtccttggcaaaataaaaatttattgattgaaattataatatcctagctaccttattgtgcctagctcttaccactgaggagaaaaaccaaacgcaaacaaaagtatgttcaaattggcaaaaatgtttacaaacctgcaaaatctcttcagcctatcccttaaactgcaggcttggtatttactaagctctgttgtgtacaatacccaccttaatatccattcttgcacaagttctgttaggtataagccaaaatcacatgggattttttttttttaccctctcatgcctatgtttgcttttgcttccaaagacccttctgagtaaggactgtcctcagactactggagtcacttagtcacaagcttgcctgaggctcagagctggcaatacctggcagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccaattgagaaagatagtgatttacttcggactgtgaaaagagagactaaaatctttactttctcatgggaaagaagcctatggtgaaagagaaacaaagaaaatggtgggaaataggataggtctactcagtagctttaaaccattctgtcatattataaagcctggtaagggttttaactaacacaagtgcctggactctacacatagagattctgatttaaatgcttccaggtgggtggaagacactagtagtcttaaaaagctcccaagtaattttaacatgtagctaaagatgaaaaggacaatctatctactagaatgtcaagtcgccagcataggagtgtcccaaatgtgcagctacctcatagaaaaggcttaaccccatccattgatggaatttgccttcctctctccatggtcttgtttgcatagcatggaaaaaaagagaagagaaaaagaggtagatggatagattgaacctataatttgcctatgtggagcagtttctcaaacttttctgaccacaagatacagtgagaaatacacaattctttgtgatcagtttttaaaaaatcttttattatgtgtaatccacccttcctggtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagcctgaccaacatggaggaaccctgtctctactaaaaattaaaaaaaaaatttttttttaattagctgggtgtggtggtacctgcctgtaatcacagctacttgggaggctgaggcaggagaattgcttgaaccctgggggtggaggttgtggtgagccaagattgtaccattgcactccagcctgggcaacaagagcaaaactgtctcaaaaaaaaaaaaaagaaagaaagaaagaaaaaaaaagacaaagaaagaaagaaaaagacaaagaaagaaagtaagaaagaaagaaaattttttttcacttttgctcagcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccgtctaactgctcctaaatctgtgatgtagtggaaaaggtttgaggccttgattctcatcccaggtttttcacctacagatcatatggccttagcctcttgacaccattgtctccttatggccaaagatggaactgtacttgggtggtatctgagcaccctgttggctttgacattctaagggctcttcccttggcaccactctcttatttaaaaggaataggatgtggacttacaagggttatttctctgcaaactatcctctctttcttatgacaagctatttctgaatgtgcacatttgaggctaagcaaatccctttcctgggcagggtgtgaaagacctttatttctctncagaggagtattatgggaggtggtagagacctagctaactcatctgcagtggctttgagcaagggctttagagccataaggtggggctgggtcctgtgtcctacaccacaggccagctagttcatttcaggagactttcttttcaatctattattactatcttcttctagactgtagttcactaccagagattatccacttagctgcactcagtttgcacctggcctgtatcaccacttagctctcactctagcctcagttaggtatcagcaagacctcaccaaagattattgtttcgttgtatgtgtgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgagaagcaaattttatagccactccagatttgtattccaaatggatagtttgattgtagaaatcacatcccttcagtctgcaaatgtgataactgcccaagagacagtgatgcctagatccataaataatcccctttcccccaacctatatataactggagtcaacagcagctagaggaaaatggcaaggacttggaatcaagattaagttagaataacactgctgtagactgtttatcagctcttcagcatatgtccattttccttgaaggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatggtagtgacgcagggcaggcgaacctcaaaactggtttgtagcctgagaaatttctcccagactgtagtttccttggctttgccaaggaaagaattcaaggtcaagccgctggtgaaagaaagcaacttttattgaactggtgctgctacttgcagagcagggctaacccataggcagtgtgcccagagttggtgcctgtgggctgctagctagttgtatttagacccacttttaattacatgccaattaagaggtaggttattcagaactttctggaaaaggggcagggagtttctagaaccgtataaagtaacttccaggccattgccaaggtgtgttgccatgacatttgtaaactggccatggtcccagtggtagtgtctttatgctcataagtagtgagagcaactagaggtcactttcatcatcatctgctggtttcagcaggcttctccactgcaccctgttttgaccagatcctgctctgttcaatggggttgtgactggaaaataagtctttctggtctcctacctcatttccccatcagagattatatactcctccttaatcttaaggggcttgcagaagggtgcaggttcatcttctgtaactgcttcctgctgatgttatgggcatagactctgcctagcactggagaagtaaaatctctggatacctgttctaaaagacccaaaggcaggatgtctttattttctgggtcagaagaggggatgggttgaaagccttgtgccagcatcatctttacatggaattattgtaatctagaagacacaaactttacaaggaggttaaacaagcaaggaccaaagattagtaataacaagatatctgttaaaggtcctaggaagggtaaaaatcaagtgtctgctggtagagattcctttattgaattccatcagcagggcaaagcggtaagagagaaaatattataattaggagtaagagaaaaactttcatgctcatccacagcatcatgttattaatatttatctgtgcatttgcaaaacaatagctttaagtcttctgggagtttgcaagtataggtcatggtatcttcctctgacatctgtgaggactcataagaatctttgaggctgggcacagtggctcatgcctgtaatcgcagcactttgggaggctgaggcaggcatttcacaaggtcaggagttcaagaccagcttggccaacatggtgaaacctcatctttactaaaaatacacacacacaaaaaaaaaaattagccaagcctggtggcacgtgcctgtaatcccagctactcaggaggctgagacaggaggattgcttgaacccagaaggtggaggttgcagtgagccgagatcgagccattgtactccagcctgggcgacagagcaagacttcttaaaaaaaaaaaaaaaaattaactttggagtttaacagcagtgggagtgtttaataatgcctgataggggccctttctattttggttgtaattgattcttgggggatccttctttctaagtttttagtaagactaagtctcctggttgaatgggggagttaatccttttccttgtgggaggttacgtttcatttccatattttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccatgggagcccaggtcatggggcagccagggcctctgcagtgtgaggcgccggtctgcgggcgggcaggcgggaggcttagggtgggtcgcggtcgcggcccccgccgcaggccctggcggcggcatcgtgaacatagacgtggagttccacatccggcacaactacccctggaacaatttgccggccaatgtgaggcagtcattaagtggagatagctcatcatggaggtcttcatctttgtcttcacatcaagtaggctgaggaggaggaaatacaggaagtattggtcctgctgttcagagtggcagaggagaaagaaaatcccagccgtgttggaaattcacagagagaatatgaaaatcaggttgtcctgtacagtatctgcaatcag

SEQ ID NO: 13178 - DNA, 8556 bp, Homo sapiens
gtgatggtccctttggttttggtgcctcttccatgagcttcagatcagaactagctatgtggttccaggctgccttggtttaatcccttgtcttgcctacttcacctggctcaagagggaagtccaggaggaagaaatggatgaagtcctggagtactcactagatgaacagtatttgactcattccagctgccatgactcccaccagcttcccagcagcaatgccttcctctttgatgcacaggaaggcccctcggctgtggaaacagccagtaagtgctcctttgataagaaaaataaagctccatcaatctctcagtagctcctacattctacatgctcaccactctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagaccggcatctgcaagccggtatactcaaagcaggccagaatggagagagtgaagagattatggcagactctctgccactactgccgcgcatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccaggttcaaatgaccctcccacctcagcctcctgagtagctgagaacacagatgcatgccactactcctggctattttttttgcctttttggtagagatgggttcttgcttttttgcccaggctggcctcaaactcctgagctcaagcaattcacccacccctgcctcccaaagtgctgggattacagatgtgagccaccgcacccagccttcctgaaatactcttgataattatagttcctgaacagctttcccaagctgttctagccatcccaagaatgttggcaggcttgtccatatgtttggaggtgcaattataatggttcctgggtttcaagctccagtctccatctcccctcagatgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttcgtctcagtgttgtaattccatctaaataaacaatgaggctatctgctggagaaaaggctgaatctaagagcaatgccgccagcatgccctcttcccagaataactccacgctagccattggagcttcattaggtatataagagccctttggtttggtagcctctctggtgtgtgtatagattaaaaccttgacctatatctcctctcccttacttgaatgtttgactttactttgggggcaaaagtttggattgttaggagactatatgctttatatactcttctatgcaataaaaagagattatattaattcactcattgagctttcacagtaatataaaccatattaggcttgtcattctgtcagtgatgggtgtaagtttgtggctttaattagtcataccatcttctgacaaaggcatccttatttctctttccaatttcacagtaatggtgcagaagaaggtctttaccatctgttaaagatgttcagggccgggcatggtggcccacacctataatcccagccctttgggaggcctaggtgggtggatcacttgaggtcaggagttcaagaccagcccggccaacatgctgaaaccctgtctctactaaaaatgcaaaaattagccaagcatagtggtgcacgcctgtagtctcagtcacttgggaggctgaggcatgagaatcctttgaacctgggagatggaggttgcactgagccaagatggtgcctctgcactccagcttgggtgacagaatgagactctgtcaaaaaacaacaacaaaaacaaaatatgttcaggagagatattttgtagagaggaagatattccctagtacctataagtcatctcaaggaagtggtcataccttttctagtgctagaaaagccctactcagagaccttcagtgttttcccacctcctgtcaacctgccttatacttcccatatctccatgtgggaggcatccctgtggagtttgcttagcacttggccatgctttctttgaaaccttaaaagctcttaaagaaagttgccttatgttccctgatgagaagatgaagttggcaaaagaatggtgaaaggcagggatcttgacgagaggcccctgactatccctttagtgatcagcatcttcacttcccatctcattccatgtcctggtggaatggctgcagaagatgagatccagagccagtggcagcacctgaaggagacccttttcatcaacaactgcctgtgagaaaagctagaacgtcatcacagcagctttgatgaagaaaatggtaggagaggcccaagtcagcctgcttctggcaatatgtatttttctaaaggcgtgtgactggggcagagttttatagatttcaaacactttgacatactttacttcacttattcattacaaatgtcccagctagagaggcagggcagctactatcattcctatttataggtaaataaataggcttaaagatatgccttcatcttagaggtatctacttctaaaatcattcttgtgattcctaagctgtctgctgtcttctgtctgctgctgtacactgcctgctgtctctctgcttcttatgtgattggcattcagtagaacccaggtttctgagcacctcacataacagaatgagtctcctctgctgccatcctcatcatcttcccttatgtcttggtgactcttcattctaccaccccaaggtggttctctccaacccccctcctcttagattgttctcacacagaggccatcatttcataacattgtgctgggccagaagaaccataagcaggtcccttcccataccaaagccgtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaatgtgtataacttgcataaattgtaataatttcctggaacaggatgcacctctaacctctacaggcaaatcatagattccattgtccagctgtataatgaaaacagagttctcagagaagaataccggagactcccccgacttgcctgaatcaaatttccagaggtaagtggtgaaaggccacaatatgaagtcactctcagatgggtcccttctcttgccacactccactgtagaaataaaagaggacggggaggccagagctgctcaaaaccttataacccacaattctcatagctattctcaacttagagagggctgctttctagacacaccccctccaggcccccagactgccaggctccaggaataagtagctctaagaaatacagtatttcggtgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcgccactgcattctagcctgagtgacagagcatgattccatctcaaaaaaaaaaagaaaaaaaaaaaagaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccgtgagccaaaaaagagcaaaagtcctaattttcaaactgatgaaaataaagtactaaataattgaaatcgtcgtagttcatcttggtccttggcaaaataaaaatttattgattgaaattataatatactagctaccttatcgtgcctagctcttaccactgaggagaaaaaccaaacgcaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggtagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccagttgagaaagatagtgatttacttcggactgtgaaaagagagactaaaatctttactttctcatgggaaagaagcctatggtgaaagagaaacaaagaaaatggtgggaaatagggtaggtctactcagtagctttaaaccattctgtcatattataaagcctagtaaggttttaactaacacaagtgcctggactctacacatagagattctgatttaaatgcttccaggtgggtggaagacactagtagtcttaaaaagctcccaagtaattttaacatgtagctaaagatgaaaaggacaatctatctactagaatgtcaagtcgccagcataggagtgtcccaaatgtgcagctacctcatagaaaaggcttaaccccacccattgatggaatttgccttcctctctccatggtcttgtttgcatagcatggaaaaaaagagaagagaaaaagaggtagatggatagattgaacctataatttgcctatgtggagcagtttctcaaacttttctgaccacaagatgcagtgagaaatacacaattctttgtgatcagtttttaaaaaatcttttattatgtgtaatccacccttcctagtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttttttaaattagctgtgcgtggtggtacctgcctgtaatcacagctacttgggaggatgaggcaggagaattgcttgaaccctgggggtggaggttgtggtgagccaagattgtaccattgcactccagcctgggcaacaagagcaaaactgtctcaaaaaaaaaaaacaaagaaagaaagaaaaagacaaagaaagaaagtaagaaagaaagaaaattttttttcacttttgctcagcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcatcccgggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcccttcctgggaggtgtgaaagacctttatttctctccagaggagtattatggatgtggtagagacctggctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttgcacctggcctgtatcaccacttagctctcactctagcctcagttaggtatcagcaagacctcaccaaagattattgtttcgttgtatgtgcgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgaaaagcaaattttatagccactccagatttgtattccaaatggacagtttgattgtagaaatcacatcccttcagtctgcaaatgtgataactgcccaagagacagtgatgcctagatccataaataatcccctttcccccaacctatatataactggagtcaacagcagctagaggaaaatggcaaggacttggaatcaagattaagttagaataacactgctgtagactgtttatcagctcttcagcatatgtccactttccttgaaggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgacgcagggcaggcgagcctcaaaactggtttgtagcctgagaaatgtctcccagactgtagtttccttggctttgccaagcaaagaattcaagggcaagccgctggtgaaagcaagcaacttttattgaactggtgctgctacttgcagagcagggctaacccataggcaatgtgcccagagttggtgcctgtgggctgctagctagttgtatttagacccacttttaattacatgccaattaagaggtaggttattcagaacttcctggaaaaggggcagggagtttccagaaccatataaagtaacttccaggccattgccaaggtgtgttgccatgacatttgtaaactggccatggtcccagtggtagtgtctttatgctcataagcagtgagagcaactagaggtcactttcatcatcatctgctggtttcagcaggcttcttcactgcaccctgttttgaccagatcctgctctgttcaatggtccttctggtctcctacctcatttccccatcagagattatatactcctccttaatcttaaggggcttgcagaagggtggaggttcatcttctgtaactgcttcctgctgatgttatgggcatagaccctgtctagcactggagaagtaaaatctctggatacctgttctaaaagacccaaaggcaggatgtctttattttctgggtcagaagaggggatggattgaaagccttgtgccagcatcgtctttacatggaattattgtaatctagaagacacaaactttacaaggaggttaaacaagaaaggaccaaagattagtaataacaagatatctgttaaaggtccgaggaagggtaaaaatcaagtgtctgctggtagagattcctttactgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgagg

SEQ ID NO: 13179 - DNA, 8557 bp, Homo sapiens
gtgatggtccctttggttttggtgcctcttccatgagcttcagatcagaactagctatgtggttccaggctgccttggtttaatcccttgtcttgcctacttcacctggctcaagagggaagtccaggaggaagaaatggatgaagtcctggagtactcactagatgaacagtatttgactcattccagctgccatgactcccaccagcttcccagcagcaatgccttcctctttgatgcacaggaaggcccctcggctgtggaaacagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagaccggcatctgcaagccggtatactcaaagcaggccagaatggagagagtgaagagattatggcagactctctgccactactgccgcgcatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccaggttcaaatgaccctcccacctcagcctcctgagtagctgagaacacagatgcatgccactactcctggctattttttttgcctttttggtagagatgggttcttgcttttttgcccaggctggcctcaaactcctgagctcaagcaattcacccacccctgcctcccaaagtgctgggattacagatgtgagccaccgcacccagccttcctgaaatactcttgataattatagttcctgaacagctttcccaagctgttctagccatcccaagaatgttggcaggcttgtccatatgtttggaggtgcaattataatggttcctgggtttcaagctccagtctccatctcccctcagatgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttcgtctcagtgttgtaattccatctaaataaacaatgaggctatctgctggagaaaaggctgaatctaagagcaatgccgccagcatgccctcttcccagaataactccacgctagccattggagcttcattaggtatataagagccctttggtttggtagcctctctggtgtgtgtatagattaaaaccttgacctatatctcctctcccttacttgaatgtttgactttactttgggggcaaaagtttggattgttaggagactatatgctttatatactcttctatgcaataaaaagagattatattaattcactcattgagctttcacagtaatataaaccatattaggcttgtcattctgtcagtgatgggtgtaagtttgtggctttaattagtcataccatcttctgacaaaggcatccttatttctctttccaatttcacagtaatggtgcagaagaaggtctttaccatctgttaaagatgttcagggccgggcatggtggcccacacctataatcccagccctttgggaggcctaggtgggtggatcacttgaggtcaggagttcaagaccagcccggccaacatgctgaaaccctgtctctactaaaaatgcaaaaattagccaagcatagtggtgcacgcctgtagtctcagtcacttgggaggctgaggcatgagaatcctttgaacctgggagatggaggttgcactgagccaagatggtgcctctgcactccagcttgggtgacagaatgagactctgtcaaaaaacaacaacaaaaacaaaatatgttcaggagagatattttgtagagaggaagatattccctagtacctataagtcatctcaaggaagtggtcataccttttctagtgctagaaaagccctactcagagaccttcagtgttttcccacctcctgtcaacctgccttatacttcccatatctccatgtgggaggcatccctgtggagtttgcttagcacttggccatgctttctttgaaaccttaaaagctcttaaagaaagttgccttatgttccctgatgagaagatgaagttggcaaaagaatggtgaaaggcagggatcttgacgagaggcccctgactatccctttagtgatcagcatcttcacttcccatctcattccatgtcctggtggaatggctgcagaagatgagatccagagccagtggcagcacctgaaggagacccttttcatcaacaactgcctgtgagaaaagctagaacgtcatcacagcagctttgatgaagaaaatggtaggagaggcccaagtcagcctgcttctggcaatatgtatttttctaaaggcgtgtgactggggcagagttttatagatttcaaacactttgacatactttacttcacttattcattacaaatgtcccagctagagaggcagggcagctactatcattcctatttataggtaaataaataggcttaaagatatgccttcatcttagaggtatctacttctaaaatcattcttgtgattcctaagctgtctgctgtcttctgtctgctgctgtacactgcctgctgtctctctgcttcttatgtgattggcattcagtagaacccaggtttctgagcacctcacataacagaatgagtctcctctgctgccatcctcatcatcttcccttatgtcttggtgactcttcattctaccaccccaaggtggttctctccaacccccctcctcttagattgttctcacacagaggccatcatttcataacattgtgctgggccagaagaaccataagcaggtcccttcccataccaaagccgtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaatgtgtataacttgcataaattgtaataatttcctggaacaggatgcacctctaacctctacaggcaaatcatagattccattgtccagctgtataatgaaaacagagttctcagagaagaataccggagactcccccgacttgcctgaatcaaatttccagaggtaagtggtgaaaggccacaatatgaagtcactctcagatgggtcccttctcttgccacactccactgtagaaataaaagaggacggggaggccagagctgctcaaaaccttataacccacaattctcatagctattctcaacttagagagggctgctttctagacacaccccctccaggcccccagactgccaggctccaggaataagtagctctaagaaatacagtatttcggtgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcgccactgcattctagcctgagtgacagagcatgattccatctcaaaaaaaaaaagaaaaaaaaaaaagaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccgtgagccaaaaaagagcaaaagtcctaattttcaaactgatgaaaataaagtactaaataattgaaatcgtcgtagttcatcttggtccttggcaaaataaaaatttattgattgaaattataatatactagctaccttatcgtgcctagctcttaccactgaggagaaaaaccaaacgcaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggtagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccagttgagaaagatagtgatttacttcggactgtgaaaagagagactaaaatctttactttctcatgggaaagaagcctatggtgaaagagaaacaaagaaaatggtgggaaatagggtaggtctactcagtagctttaaaccattctgtcatattataaagcctagtaaggttttaactaacacaagtgcctggactctacacatagagattctgatttaaatgcttccaggtgggtggaagacactagtagtcttaaaaagctcccaagtaattttaacatgtagctaaagatgaaaaggacaatctatctactagaatgtcaagtcgccagcataggagtgtcccaaatgtgcagctacctcatagaaaaggcttaaccccacccattgatggaatttgccttcctctctccatggtcttgtttgcatagcatggaaaaaaagagaagagaaaaagaggtagatggatagattgaacctataatttgcctatgtggagcagtttctcaaacttttctgaccacaagatgcagtgagaaatacacaattctttgtgatcagtttttaaaaaatcttttattatgtgtaatccacccttcctagtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttttttaaattagctgtgcgtggtggtacctgcctgtaatcacagctacttgggaggatgaggcaggagaattgcttgaaccctgggggtggaggttgtggtgagccaagattgtaccattgcactccagcctgggcaacaagagcaaaactgtctcaaaaaaaaaaaacaaagaaagaaagaaaaagacaaagaaagaaagtaagaaagaaagaaaattttttttcacttttgctcagcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcatcccgggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcccttcctgggaggtgtgaaagacctttatttctctccagaggagtattatggatgtggtagagacctggctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttgcacctggcctgtatcaccacttagctctcactctagcctcagttaggtatcagcaagacctcaccaaagattattgtttcgttgtatgtgcgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgaaaagcaaattttatagccactccagatttgtattccaaatggacagtttgattgtagaaatcacatcccttcagtctgcaaatgtgataactgcccaagagacagtgatgcctagatccataaataatcccctttcccccaacctatatataactggagtcaacagcagctagaggaaaatggcaaggacttggaatcaagattaagttagaataacactgctgtagactgtttatcagctcttcagcatatgtccactttccttgaaggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgacgcagggcaggcgagcctcaaaactggtttgtagcctgagaaatgtctcccagactgtagtttccttggctttgccaagcaaagaattcaagggcaagccgctggtgaaagcaagcaacttttattgaactggtgctgctacttgcagagcagggctaacccataggcaatgtgcccagagttggtgcctgtgggctgctagctagttgtatttagacccacttttaattacatgccaattaagaggtaggttattcagaacttcctggaaaaggggcagggagtttccagaaccatataaagtaacttccaggccattgccaaggtgtgttgccatgacatttgtaaactggccatggtcccagtggtagtgtctttatgctcataagcagtgagagcaactagaggtcactttcatcatcatctgctggtttcagcaggcttcttcactgcaccctgttttgaccagatcctgctctgttcaatggtccttctggtctcctacctcatttccccatcagagattatatactcctccttaatcttaaggggcttgcagaagggtggaggttcatcttctgtaactgcttcctgctgatgttatgggcatagaccctgtctagcactggagaagtaaaatctctggatacctgttctaaaagacccaaaggcaggatgtctttattttctgggtcagaagaggggatggattgaaagccttgtgccagcatcgtctttacatggaattattgtaatctagaagacacaaactttacaaggaggttaaacaagaaaggaccaaagattagtaataacaagatatctgttaaaggtccgaggaagggtaaaaatcaagtgtctgctggtagagattcctttactgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgagg

SEQ ID NO: 13180 - DNA, 8558 bp, Homo sapiens
gtgatggtccctttggttttggtgcctcttccatgagcttcagatcagaactagctatgtggttccaggctgccttggtttaatcccttgtcttgcctacttcacctggctcaagagggaagtccaggaggaagaaatggatgaagtcctggagtactcactagatgaacagtatttgactcattccagctgccatgactcccaccagcttcccagcagcaatgccttcctctttgatgcacaggaaggcccctcggctgtggaaacagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagaccggcatctgcaagccggtatactcaaagcaggccagaatggagagagtgaagagattatggcagactctctgccactactgccgcgcatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccaggttcaaatgaccctcccacctcagcctcctgagtagctgagaacacagatgcatgccactactcctggctattttttttgcctttttggtagagatgggttcttgcttttttgcccaggctggcctcaaactcctgagctcaagcaattcacccacccctgcctcccaaagtgctgggattacagatgtgagccaccgcacccagccttcctgaaatactcttgataattatagttcctgaacagctttcccaagctgttctagccatcccaagaatgttggcaggcttgtccatatgtttggaggtgcaattataatggttcctgggtttcaagctccagtctccatctcccctcagatgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttcgtctcagtgttgtaattccatctaaataaacaatgaggctatctgctggagaaaaggctgaatctaagagcaatgccgccagcatgccctcttcccagaataactccacgctagccattggagcttcattaggtatataagagccctttggtttggtagcctctctggtgtgtgtatagattaaaaccttgacctatatctcctctcccttacttgaatgtttgactttactttgggggcaaaagtttggattgttaggagactatatgctttatatactcttctatgcaataaaaagagattatattaattcactcattgagctttcacagtaatataaaccatattaggcttgtcattctgtcagtgatgggtgtaagtttgtggctttaattagtcataccatcttctgacaaaggcatccttatttctctttccaatttcacagtaatggtgcagaagaaggtctttaccatctgttaaagatgttcagggccgggcatggtggcccacacctataatcccagccctttgggaggcctaggtgggtggatcacttgaggtcaggagttcaagaccagcccggccaacatgctgaaaccctgtctctactaaaaatgcaaaaattagccaagcatagtggtgcacgcctgtagtctcagtcacttgggaggctgaggcatgagaatcctttgaacctgggagatggaggttgcactgagccaagatggtgcctctgcactccagcttgggtgacagaatgagactctgtcaaaaaacaacaacaaaaacaaaatatgttcaggagagatattttgtagagaggaagatattccctagtacctataagtcatctcaaggaagtggtcataccttttctagtgctagaaaagccctactcagagaccttcagtgttttcccacctcctgtcaacctgccttatacttcccatatctccatgtgggaggcatccctgtggagtttgcttagcacttggccatgctttctttgaaaccttaaaagctcttaaagaaagttgccttatgttccctgatgagaagatgaagttggcaaaagaatggtgaaaggcagggatcttgacgagaggcccctgactatccctttagtgatcagcatcttcacttcccatctcattccatgtcctggtggaatggctgcagaagatgagatccagagccagtggcagcacctgaaggagacccttttcatcaacaactgcctgtgagaaaagctagaacgtcatcacagcagctttgatgaagaaaatggtaggagaggcccaagtcagcctgcttctggcaatatgtatttttctaaaggcgtgtgactggggcagagttttatagatttcaaacactttgacatactttacttcacttattcattacaaatgtcccagctagagaggcagggcagctactatcattcctatttataggtaaataaataggcttaaagatatgccttcatcttagaggtatctacttctaaaatcattcttgtgattcctaagctgtctgctgtcttctgtctgctgctgtacactgcctgctgtctctctgcttcttatgtgattggcattcagtagaacccaggtttctgagcacctcacataacagaatgagtctcctctgctgccatcctcatcatcttcccttatgtcttggtgactcttcattctaccaccccaaggtggttctctccaacccccctcctcttagattgttctcacacagaggccatcatttcataacattgtgctgggccagaagaaccataagcaggtcccttcccataccaaagccgtaactattttggaaaagcctccttcatattgcagccattggacatgataatacatgtgatgtgctggcatttgttgagaatcatgtgaaaattaagcttccaccccatcacactaacgttccagccctccacggtctttctccctaggctaagatagagaggaagaacatgaaatgtgcagaaagcattctcttaagcaaatgtgtataacttgcataaattgtaataatttcctggaacaggatgcacctctaacctctacaggcaaatcatagattccattgtccagctgtataatgaaaacagagttctcagagaagaataccggagactcccccgacttgcctgaatcaaatttccagaggtaagtggtgaaaggccacaatatgaagtcactctcagatgggtcccttctcttgccacactccactgtagaaataaaagaggacggggaggccagagctgctcaaaaccttataacccacaattctcatagctattctcaacttagagagggctgctttctagacacaccccctccaggcccccagactgccaggctccaggaataagtagctctaagaaatacagtatttcggtgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcgccactgcattctagcctgagtgacagagcatgattccatctcaaaaaaaaaaagaaaaaaaaaaaagaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccgtgagccaaaaaagagcaaaagtcctaattttcaaactgatgaaaataaagtactaaataattgaaatcgtcgtagttcatcttggtccttggcaaaataaaaatttattgattgaaattataatatactagctaccttatcgtgcctagctcttaccactgaggagaaaaaccaaacgcaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggtagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccagttgagaaagatagtgatttacttcggactgtgaaaagagagactaaaatctttactttctcatgggaaagaagcctatggtgaaagagaaacaaagaaaatggtgggaaatagggtaggtctactcagtagctttaaaccattctgtcatattataaagcctagtaaggttttaactaacacaagtgcctggactctacacatagagattctgatttaaatgcttccaggtgggtggaagacactagtagtcttaaaaagctcccaagtaattttaacatgtagctaaagatgaaaaggacaatctatctactagaatgtcaagtcgccagcataggagtgtcccaaatgtgcagctacctcatagaaaaggcttaaccccacccattgatggaatttgccttcctctctccatggtcttgtttgcatagcatggaaaaaaagagaagagaaaaagaggtagatggatagattgaacctataatttgcctatgtggagcagtttctcaaacttttctgaccacaagatgcagtgagaaatacacaattctttgtgatcagtttttaaaaaatcttttattatgtgtaatccacccttcctagtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttttttaaattagctgtgcgtggtggtacctgcctgtaatcacagctacttgggaggatgaggcaggagaattgcttgaaccctgggggtggaggttgtggtgagccaagattgtaccattgcactccagcctgggcaacaagagcaaaactgtctcaaaaaaaaaaaacaaagaaagaaagaaaaagacaaagaaagaaagtaagaaagaaagaaaattttttttcacttttgctcagcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcatcccgggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcccttcctgggaggtgtgaaagacctttatttctctccagaggagtattatggatgtggtagagacctggctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttgcacctggcctgtatcaccacttagctctcactctagcctcagttaggtatcagcaagacctcaccaaagattattgtttcgttgtatgtgcgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgaaaagcaaattttatagccactccagatttgtattccaaatggacagtttgattgtagaaatcacatcccttcagtctgcaaatgtgataactgcccaagagacagtgatgcctagatccataaataatcccctttcccccaacctatatataactggagtcaacagcagctagaggaaaatggcaaggacttggaatcaagattaagttagaataacactgctgtagactgtttatcagctcttcagcatatgtccactttccttgaaggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgacgcagggcaggcgagcctcaaaactggtttgtagcctgagaaatgtctcccagactgtagtttccttggctttgccaagcaaagaattcaagggcaagccgctggtgaaagcaagcaacttttattgaactggtgctgctacttgcagagcagggctaacccataggcaatgtgcccagagttggtgcctgtgggctgctagctagttgtatttagacccacttttaattacatgccaattaagaggtaggttattcagaacttcctggaaaaggggcagggagtttccagaaccatataaagtaacttccaggccattgccaaggtgtgttgccatgacatttgtaaactggccatggtcccagtggtagtgtctttatgctcataagcagtgagagcaactagaggtcactttcatcatcatctgctggtttcagcaggcttcttcactgcaccctgttttgaccagatcctgctctgttcaatggtccttctggtctcctacctcatttccccatcagagattatatactcctccttaatcttaaggggcttgcagaagggtggaggttcatcttctgtaactgcttcctgctgatgttatgggcatagaccctgtctagcactggagaagtaaaatctctggatacctgttctaaaagacccaaaggcaggatgtctttattttctgggtcagaagaggggatggattgaaagccttgtgccagcatcgtctttacatggaattattgtaatctagaagacacaaactttacaaggaggttaaacaagaaaggaccaaagattagtaataacaagatatctgttaaaggtccgaggaagggtaaaaatcaagtgtctgctggtagagattcctttactgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgagg

SEQ ID NO: 13181 - DNA, 478 bp, Homo sapiens; identical to SEQ ID NO: 12729

SEQ ID NO: 13182 - DNA, 835 bp, Homo sapiens; identical to SEQ ID NO: 12730

SEQ ID NO: 13183 - DNA, 379 bp, Homo sapiens
ccaataaagccagtggaaattgccatagaggcatggtgggtggtgcaggctggatatatcacagaagatgacatcaagatatgcacttggcctgagaaatgtgctactgataagaccgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaa

SEQ ID NO: 13184 - DNA, 579 bp, Homo sapiens
aaaaagcagaaactgctgattgttcttttttttgttgactgattatacaatgtgtccttttaaaaatggttctctgttctctttgcagttgttgtattggttcctagttcctagtaatttctcacacttagttaaccagtcagtcttaccaaaaagtaaactaaccagggatccctggtttctgtatctttaaaacctatagggttacaaaccaaagtgagatgcctatctggtttctgcacagttgtcctgaattatgttggcagatattttatagccagaaattaaccttgaaaaataaattgaaaccataccaagtatttagagctaggggtctaaaatctgcaaaagccctgggaggttgtgttgtctcaagagccagtattcagtggaccactccacatcatattaaataaaatttaaacacagcattttgaagccgacagtatgggtcactgtgtgtcctgtgtgccctgagcgtattgtagagtagttgttgagtctgctgccttatctgtgtgttatgaggtcaatgcactgatcacttgcttttttcacttctatactaactctaggcac

SEQ ID NO: 13185 - DNA, 246 bp, Homo sapiens
tccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcag

SEQ ID NO: 13186 - DNA, 579 bp, Homo sapiens
aaaaggcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccgtgggaggttgtgttgtctcaagagccagtattcagtggaccactccacatcatatcaaataaaatttaaacacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcac

SEQ ID NO: 13187 - DNA, 579 bp, Homo sapiens; identical to SEQ ID NO: 13186

SEQ ID NO: 13188 - DNA, 246 bp, Homo sapiens; identical to SEQ ID NO: 13185

SEQ ID NO: 13189 - DNA, 579 bp, Homo sapiens; identical to SEQ ID NO: 13186

SEQ ID NO: 13190 - DNA, 1702 bp, Homo sapiens
atggagacttcaggtgaaagaagttaagtgaattctttgttgagtcacaaattttgagccagtcagaatttgaacctaagatttttgactgctggttgtcacacttcccgccccacactcaactgttgtgtgaatgagccagacacattgcttaacctgagtccgagatggacaatggtataggaaagatattcggtatggagaatcagatgttaacttgtgttgctatttttgttttgttttgttttgttttgtttttgagacaaggtcttgctctgtcacccaggctggagtgcagtggcatgatcagggcttactgcagcctcaccctcgatttcctgggctcaagcaatcctcccacctcagcccccaagtagctgggcctacaggtgcgcgctaccacgcctggccaattttttaaattttagcacagatgaggtctcactatgttgcccgggctggtctcgaactcctgagctcaagggatcctcccgcctcagcctcccaaagtgctggtgttacaggcataagccaccacacctggcctgtgttgctattatatttggcaggaacccagagtccagaacatttcatctatgatgggttagataatgtgtctagttgtttgcatgccaatttcagtagcctcagttattcaacctaggagatttttctacctctttactaccctgctgaagttgctcttcagcagaaaatctttgtggaacacattccacactttgaaatcttcgtggaacaaaagatatttgtggaaccaatctttgtggaacatattccagctttttgaatgagtgcatatccagtagtacctttaaagtaacactttgtacataacaaatactcagcaaatgtgaaactttatttgctcttacttcaaaattagtccaaaatgttggaaataaaatataagacattgatctagatatgaggtttttctccttcattctcagctgtcgaagaaatcaaagtagcatatgcacaaggttaaaaaccacatatacaaatactatagaacagcttataatgaaaaccttgcctgcctttataaaaaatgtgattatcttcttctgttaatgtcaataaaagatggtttgtcctagaaggtctataaatggtattatgttctggaggaaacctagcaaaaactttgctagtttagtacttgtctctaaattgatgttcacccatttcaatattgcacttattaatggtctttatttttctagcatagataacaattgattctttagattcatatatggaggtaattcttgctttctaaagaaaggaatatggcacattggaaccattttattcaccagtggatttacccttagagtatttttagatctgagctgatgacttgtgagagaaaaagggaacagagtaaagccatggaagccatgaacagtaagagactgctgcctggcatggtttcttcttctgcagaagatgaaactgaggagaaacaagacaacatccttcataccaggaatggtcaagataatgcaagaagaaaaaagctttcaaacaaatcagaaggcagtcaacaaacagaaagggggacattccttccctggcagttactcaaaactgaaattgcttattgtgtacaccggggcttgtacttggggaatttaataaaaatgctcattaccaagctccagagagatgtggttta

SEQ ID NO: 13191 - DNA, 1100 bp, Homo sapiens
agtgaagctggagctacctcattcttttaactggctgcgtggcgttccattgagtgtctgtcatcatgtgtttagccgagtggatggatagtctgcttgtttttagtttttgctcttaacaaacactgctgcagtcagcatccttgcacagatttctttgtatacttgtattagtatttctgtaagatctgagaagtggaatttgtagggtcataggttatgtacacttaagtttttgacactcactgccaagtcatctgtcagaattctaaactaaagacatgtttggagtgtggatttatcttcagtttttctttggacaagaggaagctgtgaaagattttgctatcagaaaattttggttctttgtcttttgcacatgttctttgagtcttagtatctgtaacgtggcgctactctctctatcatgggggggcatgttttgacattaaattgacttttaagaaaaacatgtcactaacctgaagctcagccacacagtgacttttaaggttttatttagactttactgttgttctcatgagagtaggtacagactgcataaggtttagaatcccagcatatgtctgaaacgacgggactttcactgtgatttccaccagagaaattatagcagagtggctgagcatgtgctctgaggccaggccccagctctgctgctgatgagctgtgtggtcctgggcagagtggtctccgagttccagtccctcctctgtaaaatgggcatgattagagtgcccaccgcattagggatgttggggtgagtcagtgtgaccccacgtgcacagaaagtgctgcgagtggtgcatggtgagaggttgatgcaggtacttagcccttggggaacacaggtagttccttttcactgtgtttaatttgggaaaatccagatccacatcattgtagagtctgagggttagaaggaagtcattgtgtctaacataacaacagagcagtttgtgtcactgagctccagtctgtgctggattattgatattgttggtggcggtcaccattcctggaaagggactgtcccaagccacttaccttcccgaggagtctgctggttctccttgagg

SEQ ID NO: 13192 - DNA, 640 bp, Homo sapiens; identical to SEQ ID NO: 11932

SEQ ID NO: 13193 - DNA, 606 bp, Homo sapiens; identical to SEQ ID NO: 11933

SEQ ID NO: 13194 - DNA, 628 bp, Homo sapiens; identical to SEQ ID NO: 11934

SEQ ID NO: 13195 - DNA, 640 bp, Homo sapiens; identical to SEQ ID NO: 11932

SEQ ID NO: 13196 - DNA, 513 bp, Homo sapiens; identical to SEQ ID NO: 11936

SEQ ID NO: 13197 - DNA, 612 bp, Homo sapiens; identical to SEQ ID NO: 11937

SEQ ID NO: 13198 - DNA, 462 bp, Homo sapiens; identical to SEQ ID NO: 11938

SEQ ID NO: 13199 - DNA, 640 bp, Homo sapiens; identical to SEQ ID NO: 11932

SEQ ID NO: 13200 - DNA, 640 bp, Homo sapiens; identical to SEQ ID NO: 11932

SEQ ID NO: 13201 - DNA, 654 bp, Homo sapiens; identical to SEQ ID NO: 11941

SEQ ID NO: 13202 - DNA, 414 bp, Homo sapiens; identical to SEQ ID NO: 11942

SEQ ID NO: 13203 - DNA, 647 bp, Homo sapiens; identical to SEQ ID NO: 11943
  misc_feature (29)..(29): n equals a,t,g, or c

SEQ ID NO: 13204 - DNA, 27750 bp, Homo sapiens
ctcaaggtcatcctcatgtcggccaccatcaacatctcgctcttctccagctatttcagcaatgcccctgtggtacaggtgcctgggaggctgttccccatcacggtgagtacttccccctcctcccacatccccagacctccaacctggtctctgtccaaacctggacatgcctcttctctctgctgctgtatctcccatctctttcatttaaagatgttctctttttttaaagctaccattttctgagcattcataatcagctggttagagtgctaagtgcttgttagagtaaaagctgttacaagaagacccaaaaatggctgggcgccgtggctcatgcctgtaatcccagcactttgggaggccgaggtgggtggatcacgaggtcaggagattgagaccatcctggctaacatggtgaaaccccatctctactaaaaacacaaaaacaaaattacccaggcatggtggtgggtgcctgtagtcccagctactcgggaggctgaggcaggagagtggcgtgaacctgggaggcggagcttgcagtgagccgagatcgcgccactgcactccagcctaggtgacagagtgagactttgtctcaaaaaaaaaaaagacccaaaaatgtaaagtctcaaataagagaagtttatttctctcatataacagtgtggctggtccaggctgttgggcaactctgttccatgtggtcattcagggatccgggctcctcctttgtcattactctgccatctcactgggcaggatttctcaaagtcagcaagattgacatttcagtctggataattccttgtcgtgggggctgtcctgtgcattgtaggatatctagcagcatccctggccctacccactagatgctagtagtcttctcctctggttgtgactattaaaaatgtctccagacattgccatatgttccctctggggcaaaaccacccctaattgagaaacactgtcctagtgagttatccttgtctgtatagtcaagacttacaggaagaacttcattgtctcttgtgatttctggttccggatgcccatcaatttgccttctaagcagccataaaaaaagaaagaatgggtcgggcacggtggctggtgcctgtaatcccagcactttgggaggctaaggcagaaagatcacgaggtcaggagcccaagaccatcctggccaacatggtgaaatcccatctccactaaaaatacaaaaattagctgggcatggtgacgcacgcctgtaatcccagctacttggaaggctgaggcaggagaattgcttgaacccggaggtcgaggttgcagtgagccaagatcgctccactgcactccaccctgggaacagagcaagatcccatctcaaaaaaaaaaaaaagaaagaaaagaaagagagagagagagtgcgagccgagtgtggtggctcatgcctataatcccagcactttaggaggccgaggcgggtggatcacctaaggtcaggagttcgagaccagcctggccaacaaggtaaaaccccgtctctactaaaaatgcaaaaattagctcgagtggtggtgcgcccctgttatcccagttactcaggaggctgaggtgggagaattgcttgaacctgggaggtggaggctgcagtgagccgagatcatgccactgggtgacagagcgagaccctgtctcaaaaagaatgaggctgcttcctgagaaatgttttctagggtttttgttttttgttttttgttttttttagtagagacgacgtgttgctatgttgtctgcctggtcacgcatacctgagctcaagcaatcctcccgccttggcctcccaaagagctaggattacaggtgtgagccaactatgctgggaaatcagccaaccaacctggctcaggctcagggtcctctcctggtcagccaaccaacctgatttctaggtttttaatcctggtttcatcacctagaatattttttttgttgaagctactctaaacataagataatgcatgcattgtaagtatatagcttaattagttttcaccagttacatacatctgtgtagctagcacccaggtttagaaaagtcaaacattgccagcaccccacaagccttgcagttgctttgttactttgtctttttattacatccttcagaaattatctagctggagtgtgctgtctgtcacctgactgtttctcaattaggggtggttttgccccagagggaacatatggcaatgtctggagacatttttaatagtcacaagcagtggagaagactactagcatctagtgggtagggccagggatgctgctagatatcctacgatgcacaggacagcccccacgacaaggaattatccagactgaaatgtcaatcttgctgactttgagaaatcctgcccaatgagatggtggcataatgagaaaggagaagcctggatccctgaatgaccacatggaacagagttgcccaccagcctggacccgttgcactgtcttctccgttagcctgtggtctcccccgtcagcctgcagcctccccagcccattgctctgagctggagggacagggtgtgcttctacctggggctgtctcctctcaggttgtgtaccagccgcaggaggcggagccgaccacgtccaagtcagagaagctggacccgcggcctttcctgagggtgctggagtccattgaccacaagtacccgcctgaggagcggggtgacctcctcgtcttcctcagcggcatggcggagatcagcgccgtgctggaggctgcccagacctatgccagccacacccagcgctgggtggtactgccactgcacagcgccctgtctgtggccgaccaggacaaggtatcacaggaagcccgagtggggcaggcggggggtctgcatgagtcaggggtggctgcgcacaggacttgtgtaactccacaaacacagggctcgggggctgtacttgtgcaaagtcgtagccacctagtggcagagccaggctgcgaacccaggtagtttggccccggagcccatgctctaaaccagaggtcggcaaactttctataaagggtcggagtagatgatgtcagtcctatcgaccatgggctctctgtctgtcacagctactcagccccactgttgcagcatgaaagcagccataaactgagtgggtgaggctgtgttccaaaacagttttttttttttttttttgaaacagggtcttgctctgttgtccaggctggagtgcagtggcacgatcagggctcactgcagccttgacttcttgggctcaagtgatcctctctccttagtctcccaagtagcaactataggtgtgtgtcactaaactccattaatttttttttctttttgggacagagtctcactctgtcgtccaggctggagtgcagtggcatgatcgtggcttactgcaatctccacctcccgggttcaagcgattctcctgcctcagcctcctgagtagctgggactacaggcacccgccaccacgtccggctaatcttttgtatattgagtagagatggggtttcgccatgttggccaggctggtctcaaactcctgacctcaagtgatctgcctgcctcagcctcccaaagtgctggggttacaggtgtgagccactgtgtccggcctccgttaatttttttttgaattttagtagcaaagaggtctcactgtgttgcgcaggctggtttcaaactcctgagctcaagcgatcctcccctagtgggggcagtgccagtttatgcttcagcagatccctctggctgccatgtgagtctacaggccagagatctgaggggaagctggagtaggatcagagtgggcgaggagaggcctggaccagggcaggggctgggctgtcggaggagggaaggatttcaagaaaagttccagatggcctggtacattggctcatgcctataatcccagcacaggaagctgagacaggaggatcactcgagctcaggagttagagaccatcctaggcaacacagtgagaccttgtctctacaaaacggaagaaaactagctgggcatggtggcatgtgcctataatcccagctacttgggaggctgatgcaggaggatcgcatgagctcaggaggtcagggctgcagtgagctgtgatcacgccactgcactccattgtaggccacagagtgggatcctgtctcaaaaaaaaaaaaaaaagttcaagatgttcaggtcgggggagcagttgtggtggctcatgcctgtaatcccagcacattgggaggccaaggcaggcggatcacctgaggtcaagagttcaagaccagcctggccgacatggtgagaccccgtctctacttaaaatacaaaaattagccgggcatggtggcgggcacctgtaatcccagctgctcgggaggctgaggcaagataattgcttgaacccgggaggcagaggttgcagtgagccgagatcacgccactgcactccagcctgggcgacagagcaagactccgtctgagggtgggggagggcccaggatggcccaggtgatggggtggacggtgagccatctccaaaagggaggtctctgaaggaggaaagggttccagggaagctgctgacacgggggtgggcaagaaattggacacataggttagtcggggctgagttagttcctgacaccaccccctcccttcctcccaggtatttgatgtggcaccccctggagtccggaaatgcatcctctccaccaacattgctgagacctcagtcaccattgacgggatccgcttcgtagtagattccggtaaggaccaccatgagcccctacccaccacccccaaggacttaggagcatggggtccggaggtgtgcgtgtgtggcaggggcgcaccagcttggattgggaagtacagttgactttcccatatccaaaatgcttgcttgcaaccagaagtgtttggaatttcgggtttttttgaatttggaatatttgtatcaattttattatttgagtatgtcaaatccagaaatctgaaatcctccagtgagcatttcattggagggtcacgttagtgctgaaaacatttcagattttcgagcatttcagactttggatttccagaattgggatgctggaagacgatgtgtggggccatggaccaatggcaacatcttagtttttctcacaccttccaagcctgcttctgccctggggcctttgtactgttctctctgccgagagctgtctttctccaggtatccacacaggtgacgccctcacctcatttcagggcccgcataaatgtccacccgtcagagaggcccatactgtccactctgtctaagagatatcccctcctccatccgctgttgcttgtcatatgagggggattgacattctgtttgttgttgttgttgttgttgttgttgttgttgttgttttgagacggagtcttgctctgttgccagactggagtgcaatggtgcaagctccgcctcccgggttcaagtgattctcctgcttcagcctcccaagtagctgggattacagacatgcatcaccacgcccggctaatttttgtatgtttaggagagatggggtttcaccatgttggccaggctggtctcgaactcctgacctcaagtgctgcctgcctcagcctcccaaagtgctgggattacgggcatgagccaccacgcccagcccgacattctattttatgtgctgctctgtttgctcactttctgtcttcctgactggaatgttctctgggaagtcagcatagcatagtgtttggagacactggagcctgcctggccaggtttagtgctggctgtgtggctggggtcatgtgactgacacttcatgtatcggttggctcatctgaaaaatgacaatggcaggccgtcccggctgggcgcggtggctcacacatgtaataccagcactttgggaggccaaggcaggcaggtcacttgaagttaggagtttgagaccagcctggacaacatggtgaaactccgcccctactaaaaatacaaaaattagccaggcatggtagtgcgtgcttgtagtcccagctgctcaggaggctgaagtgggagaatcacctgagcccaggaaatcgaggctgcagtgacctgtgattgtgccactgcactcaagcctgggcaacagagcgagaccctgtttaaaaaaaaaagagagagagagaaattaaaaaaataatgtctgccaggtgctgtggctcatgcctgtaatcccagcactttgggaggctgaggcaggtggatcacctgaagtcaggagttcaagaccagcctggccaacatggtgaaaccccatctctactaaaaatacaaaaatgacccgggcatggtggcgggttcctgtaatcccagctactcaggaggctgaggcaggagaatcgcttgaactcaggaggcagagtgagccgagattgtgccattgcactccagcctgggcaataagagtgaaactccatctcaaaaaaagaaaagaaagaaaatgtaaaaaaaggttgttctgacactggaggaaatatggtgctctgttcagtcctgtgagactaggacctttgtttagctcactgctgttcccctagtgcctagtgcagtgcctggtatatagtaggtgcttaataagtatttattggataagtgaacctctgaagaaacaaagacttgggaaaataaatgaaaagatgtgtgagtgaaaggctgggtgcagtggcccacgcttgtaaccccatcactttgggagcctgaggcaggcagattgcttgagcccaggagtttgagatcagcctgtgaaaccccgtcactgcaaaaaattagccgggtgtgttggtgtgcacctttagtcccagctactcgggaggctgagctagtaggatcatcgcttgagcctgggaggttgagactgcagtgagctctgactgagccactgcactccagcctgggagacagtgagaccctgtctcaaaaaaaaaaaaaaaaaaaaaaagatgtgtgaggaaatgaaagaataaatgaacaaaatgtcagagttgggcccagaataagccctcagttagcattaacagaataaaggagtaagtgagggtgttggcgagtgacaagagccaggcgcgtggccagctgcacgtggctgccacacacagactccctttcctcattgctcccatccaggaaaggtgaaggagatgagctacgatccgcaggccaagctgcaacggctgcaggagttctggattagtcaggccagcgcagagcagcggaagggccgggcgggccgcacgggccccggagtctgcttccgcctctatgccgaatcggactatgatgccttcgccccctaccccgtcccggaaattcggagggtggccctggactcgttggtgctgcaggtgaggcacgggcagaaaggggactatatcctaactgctggcacagggaggaacctgggaggccttttttattttattttattttattttattttgagatagcgtcttgctctgtcactcaggctagagtgcagtgctgtgatcatggctcactgcagcctccatattacaggctcaaatgatcctcctacctccacctcccaagtagctgggaccacaggcacacaccaccacacttggctaacttttaaatttttatttatttatttatttttgagacggagtctccctctgtcgcccatgctggagtgcagtggtgcgatctcggctcactgaaacctccgcctcccaggtttaagtgattctcctgcctcagccttcctagtagctgggactacaggtgtgcaccaccaagcccagttaattttttgtatttttttttagtagagatggggttacaccatgttagccaggatggtcttgatttcctgaccttgtaatccaccctcctcggcctcccaaagtgctgggattacaggcatgagccaccgcgcccggcctaactttttttatttttagtagagatcaggtcttgctatgttgcccaggctggtctcaaactcctgagctcaagtgatcttcccaccttggccttccaaagtactgggattacagccatgagccattgtgcccagccagccaggaagcatttacataggacccaaccccagagtgtcagggtcaggaaggatagggctagccaagccactgaggggaacccatcccttccaaatgtcaaaacccttgttgaggggagaattgttccttaaatccatagggtcagctgggcatggtggctcacacctgtaatcccagcactttgggaggccaaggcaggtggatcacttgataccaggagtttgagaccagcatgaccaacatggtgaaaccagtctctattaaaaatacaaaaaattagccgggtgtggtggtgtgcacctgtaagcccggctattcgggaggctgaggcaggagaattgcttgaacccaggaggtggaggttgcggtgagccgagatcacaccactgcactccagcctgggcgatagaacaagactccatctcaaaaaaaaaaaaaaaaaatgtccatagggtcaaaggaagaaccagtgactcaatcagaatgctttcagctgtaacaggaaacctagcaggaaagggcttttaaaaccagggtttctcaatacattttatgtcatgatttgtatctcatttgttaatttagcataggttagactgccatgacaaatacacatggtcacgaatggccaacagcggaatggtggtttacaggttggcaggcaattttctttattcagggacccagggtccttcactcttgtggctctataatctccccaggggcttttcctgcatatgtgtccagccagccaaagggtcaagggcatgggaagtgagtacaggagggtttgcgggtcgagcctgcaaatggtgcacttgccttgcactcaccactcctggtcagtcctcagtctcgtggccacgcccaaccgtgaaggaggctgggaagtgtagtccttgtgctcaggaacaaaaggaaaaggaaagttgggagcagctgatggtgtctgccacaggctcacgtgcgggtgtagcacaaaccagtggccttcctgcaggaggtgcacactattttctattctgtttgatttcatcttttaaaaaaaaaaatactagtgctgccgggcacaatgagtgactcatgcctgttatcccagcactttgggaggctgaggcaggaggattgcttgaggccaggaagtcgagaccagcctaggcaacacggtgaggccctgactctagaaaaaatttaaaaattagcccagtgtgatggcacacacctgtggtcccacgcaggaggctgaggcaggaggatcgctagagcccaggagttcgaggctgcagtgagccttgattgcatcactgcactccagcctgagtgatagagcaagaccctgtctcataaaaaaacaaagtccatggggtaggtagtcttaccctaatttttggaccagaagaaggatgcagagagagagaaaatattgccccaggtcacacagctggcaagtagtagagtcagggctccatccgaggccaccaggcgtcagagcctgcttcgtgagtggccgctggctccaggcacagtgggcgtcacctcctcctcctttaccatccggaggcagaagcaaggaactgcccttctctgtgggtctaatttttaaggccacaggaacattttctagactcctctggccagtctctcatcctctcttgtcagcagaaccgggtcatatgtgttcaccctatgccccgcaattgtctagggttgtggcattgcctgagttgatcagagcagtgtctcagccccagctgcatactagaaacacctggagaatttaaaaaaaccccaggccctgccccctgcctctttaaattgagcttctaatgtaaaggttaatttatttatttatttatttatttatttttgggacagagtctcactctgtcgcccaggctggagtgcagtggtgttatctcggctcactgcaacctccacctcccaggctcaagtggttctcctgccttggcctcccgagtagctgggaccacagatgggtgccaccaggcccagctaatttttgtaattttagtagagagggagtttcaccatgttgatcaggctggtcttgaacttctgacctcaggtgatctgcctgccttagcctcccaaagtgttgggattacaggcatgagccaccgcgcccggcctataaaggtttttaaatgagtattgggtgaactcatagacggcatcaaggcttggtcagcagggaggaaggagcagcagctgcttgcaggtggacgccagaacttctagtgccctcggatcaaagccaggcaaacagacttctctgagcttccttctcgctctctggctgtcacatgagctgccttgccagcctctccttcttccagtcaccagagaggtgctgtttgcttacgtatgccacgccagaccccggggtggacatatgctgtcacttaattctcccaccatctactgcctgcctggactgctgcattaattgggattcttttggttgtaagtgagagaaatacaactgaaactattgtaggcagaaagggggatcttaccattttgtgcattcatgaggcggcatgtctaacttaggaacaatccaagaatttctccatctgctgtaggtgggcccatttccaaaaaatggacaaagtcaaaggtcacagcagttctgggttaataagatagccttccatcctggccacaaccagagaggatgctgggaatgctcttcctggctccagtctcatggaaggattctgattggtccagctcaggtcacgtgcctctcctccatggtctggggcaagatgtgctaggcagacagatacagagacagcagccctccttgcctgcctctgcacagtggatcttgacattgggaattttattttattttattttattttatttttgagatagaatctcactctgtggcccaggctggagtgcagtggtgcaatctcggctcactgcaacctccgccttccaggttcaagcaattctcctgcctcagcctcccaagtagttgagattacaggcactcgccaccacacctggctaatttttgtatttttagtagagatggggtttcaccatgttggccagtctggtctcaaactcctgacctcaagtgatccacctgctgtggcctcccaaagtgctaggattacaggcatgagccactgtgcctggctgacactgggaatttgagatggagtctcggtgtattgccaggctggagtgcagtgcagaggcgcgatctcggcttactgcgatctccacctcctgggttcaagcgattctcctgcctcagcctcccgagtagctgggattacagtcatgcaccaccactaatttttgtatttttagtagagacggggtttcaccatgttggccaggatggtcttgaactcctgacctcaagtgatccgcttgccttggcctttcaaagtgctgggattacaggcatgagccacaacgcccggccaacactaggaattttaaaacgtcatgaatttgtgatctctgagccccgctgtgctgcacagtggctcttgtgttccccaatcttgggggttttgcttctcattctagatgaagagcatgagtgtgggggacccccgaaccttccccttcatcgagcccccaccaccagccagcctggaaaccgccatcctctacctccgggaccagggggccctggacagctcagaggccctcacacccattgggtccctgctagcccagctgcctgtggacgttgtgattggtgagtacccacccccctcgtgatcactcagggccccaggagcgggtatgggcacagctcactctctgagtggcctgggggcaagtctgtttcttccctgggtccagttcatttattcactcttcactgggccaggcactgttctaggtgctgggcatatagcagtggacagaacagacacaaatctctggcctcagggagctgacattttggtgaagaagaccagcaatacattaggacaataaggaaaaggcatagtagatcagatggtgcctagtgttctggagagaagaaacaacggggttggggaatggggagttgcagtttgtaatacaggcctcatgtataaggcagacctcatggggaaggtaacatctgtgcagagaaatggagatgagggctaggagccatgcaaatactagaacatgcttgccagcagaagtcgagaaacatggccggcacagtggcccacacctgtaatcccagcactttgggaggctgaggcaggtagatcacgaggtcagcagttcgagaccagcctggccaacatggtgaaaccctgtctctactaaaaatacaaaaattagctgggtgtggtggcacacgcctgtaatcccagccacttgggagggttaggtaggagaatcgcttgaacctgggaggtagaggttgcagtgatgcagtgagccgagaccacgccattgtactctagcctgggcgacagagcgagactccatctcaaaaaaaaaaaaaaaaaaaagcaaaaacaggtgagattcattttgataaaatagctgattcaacctaatatacctaaaacatcacaattttaacataatcaatagaaacatttttgcaagattttatgttattttttaccatacgacgtcttggaaatcttggtttggaccagccatgttcaactgctcagtagccatgtgtggccagaggcggccgtattggacagtgcagatggtgcatgagggtgttcgggcagtgggaacagccagtacagaggccctgtgggggcacatgcctgctgctacgggaacagtgaggagccccgtgtggctgcagtggagtgagagggagaaggtgggagatgtaaccaacagtctcatcattcattcattaaatccttttttttttttttttttttttttgagactgagtttcgctcttgttgcccaggctggagtgcaatggtgccatctcggctcaccacaacctccacctcttgagttcaagcgattctcctgcctcagcctcccgagtagctgggattacaggcatgcgccaccatgcccggctaattttgtatttttagtagagctggggtttctctatgttggtcaggctggtcttgaactcccgacctcaggtgatctgcccgccttgacctcccaaagtgctgtgattacaggcttgagccactgctcccggtccattgaatgtgtgtgtgtgtgtatatatatacacacacacacacacacacacatacacacacatatatatacatacacacatatatatacacacacatatatatatgttttttttttctttttgagatggagtctcgctctgttgcccaggctgaagtgcagtggtgcaatcccagctcattggaacttctgcctcctggattcaagcaattctcctgcctcagcctcctgagtagctgagactgtaggtgcccgccatcatacctggctaatttttgttttgttttgttttgagacagtgtttttgctctgttgcctaggctggagtgcagtggtgtgatctcagctaactgccacctcctgtgttcaagcaattctcctgcctcagcttcatgagtagctaaaattacaggctcacgccaccacgcctggctaatttttgtatttttagtagagacggggtttcatcatgttggccaggctggtctcgaagtcctgacctcaagtgatctgcccacctcagcctcccaaagtgctgggattgcagacttgagccaccgtgcccggccagtatttgttttttcagtagagaaggagtttcaccatgttggtcaggctgatctcaaactactgacctcaagtgttctgcctgcctcccaaagtgctgggattacaggcatgagccactgcgcccggccaatatttgtttttttagtagtgtcaaggtttcaccatgtcggccgtgctggtcttgaactcctgactttaagtgatctgcccacttcggcctttcaaactgctgggattacaggtgtgagccacagctcctggcccattcattaaataatttttgagcacctgctctgtgccaggtcctagtctagatgccagagatacaacagtgaataaaacaaaactcctgccctcacggagctcacatgtaacaggggagatggacaggggcagataaatgagtgaaaacacggaatgtcagccgctgattgctgctcaggtggatgcagggcacggtgggcacagtgggggctgggagcagtgttaattggctgtcctgggaggccaattaacagtgacatctgggcagaggcctgaaggaggggaggggacagctgtccctctggccctgggtcaggtgaggagctttgaattaaatgggaagtgtttaagtggaactgggtcctaagtggctgaaggtggccagaaaattgatcagttgacctggcggttctgtgaggatctggaaagggcgggtccacagaggtcgacggagaccattttcagttcccagccctcctgatctcaggtcttcagtagccagtcacaagcagatgtggtgctcctcgtccccacgctgtgtcatcaggaatagggcgttaatcttgagggatttggggccagcagaccctctgaccctgtctttcttgtgtgcaccgtcagtgtctcaggcactcacctgacgctgcagatgccaccaccagaggctgggtgtggcctgtggtgtctggcttgcaaggctgtttcagagaatgtgacgcaaagtgccctggttgtgcgtgagtgacaggaaagacaggctctctcgcttggattccccagcacttggggtcatgacagggcctcccttgggaggcacaggcaggtggagtacccaagatcccccaaacgcagaaagaagtcttggcttttccacagctcagacccctcccacctctctcctctgcacagcgtgtccccagctctgccccgcacccctctcttgcgggctcaaggatgtcaaaactcttcctctccctcattcctgagtcatgctcacccctcccggggagctcactgactgaggcttgttcatcttgcctgattctcctgactcaagactttctatttccagcagcctgaggcccaccatggcaggaccacccatgtatgtgtgttaacaccattaaagcccccatccttgcagcacagcagggcttcagtgtgggcaggaggctggatccgctggacttggagggctgcccaggctaagaagatggttcatttttgttttatttatttatttatttatttagagatggagtttcactctgtcctccaggctggagtgcagtggcatgatcttggctcactgcaacctccacctcccgggttcaagtgatcctcccacctcagcctcctgagtagctgggattataggcatgtgccaccacactcagtttttgtattttttagtagaaacagggtttcaccacattggccaggctagtcttgaactcctgacctcaagtgatccgccagcctcggcatccctaagtgctgggattacaggcgtgagcccctgcgcccggcttcatttttgttttggaaggaaacagggctagagcagggagaatctgaactgagaagcagaagaatgttctgtgagctcttgctgtgtgccggcgaaaggctctgtggactttccgttatttcatccttacctgctgagggcagggcctctgatcgcccccagtgtgtagatggggaaactgaggctgggcccaggaggctcctgagggcatggggaagcctggctttgatcggaggtgatggtaaatgcctcactcacattatctccctgagggctgggggcaggtgcccccacttgccctgtggggaaaacgaggctcagagaactgctgctcagggtcacagtgggaactgagaggcacggatgaccctgtgctgggcgtcctctgtgccaggtggagttctgaacgcttcacagggtgaaacacaaagcatcctcttggcagcctgaggagaggccaatgctgttgttcccccgtttacagatggggaagcagcgtcacggcgaggtggggccacttttccctggtgacagagctggggtgtcctggaataggacaggggcctgcacagtacagccccaagccctgctttactgccacctttgttttatgaggccagctttttttgtttgtttggtttttgagacgaagtcttgctctgttcactcaggctagagtgtaatggcaagatctcagctcactgcagcctccgcctccagggttcaagtgattctcctgcctcagcctcccaagtagctgggattacaggcgcctgccaccacacccagctaatttttgtatttttagtagagatggagtttcaccaggtttgccaggctggtctcgaactcctgacctcaggtgatctgcttgagtccagttttgtgacaggcactatggaaagtcagtgaaggtcaacggtgggggcgggtcagacacatgacacagaccactagttactggacaggtgggcaagggagcccccagaagtccagcgtcagctcgggcgcccagaaccaggggatgtctagatgcccgctgtggagcgctcacagatggagacagggttcacctgtctccaggtgagactcggccaccctgggagacggttcctgccacttttcctctctgtggcctcccctctgtccttcctcccctttccctacctctcccagcccctgccccatctttctccatgtcttcaccttctgtcccctcttcctcttccacttccaccttgacctaaacaaaggctgcaggagaagattcatcctgtgataagcacaggagtcagtgcctgcctgtgccagggcagagctagagggactcacttacaggtgacactctagcgcggaggagagacgtccaccgtgatgggtcaaaatgagctcctagagcaaagaccaagccagggaagcatcagagcgctgggggagtgggttgtaaatagcaaagtggggaacttggtgacaggagtagtcagcgcttagacagtgtctcctgtgtgtccaaggaggcagggactggccatctccaatctacaaatggggaaactgaggcccttgcccatggccacgtgaccagaaagcacagcgcgtgggtttgaatctccatctgggtcacgagacccttagtgggcaagatggagggggtgggagcaggagggcaggctggggccccgaggggtgagggctgcgcctgtcctggcacccaggagcctcaaccccgtgtccgccgctgcagggaagatgctgatcctgggctccatgttcagcctggtggagcctgtgctcaccatcgcagccgcacttagcgtccagtcgcccttcacccgcagcgcccagagcagcccagagtgcgcggcagcacggcggccgctggagagcgaccagggtgaccccttcacgctcttcaacgtcttcaacgcctgggtgcaggtgaggctggtggtgggggccctgctcagggccaaggccttctgtggctgtggctcctcctcgtgtcccaccctcagccccaccctgggaggaccactgagccccccacagactgggcctgcctggggagggccatgtctccatcatccatgctttcggctcaggacagcatgtgcccaggcccggggctgagaggagcctggggtttctgaagcactgatgaaaacctgtgccacctggagaaagtccaggctccttgggaggcatctggagatccagtatatgtcccttgagtcctcaccctaaccctggccctgtagtgtagtgctgggggcccatcagtgccaaaactaccctggccctgccctcccggggctcacagcccagtgcagggagacagaccactgatgtgacagtgacaacccagagagggctggaatggggagtccagggggctgggacaacccagcggggcatctaacccagtttgtgggtagtctgggagggcttcccataggagggggcactggggctgagacctggaagcaggagagcaggtgtccctgagggatgcccattttggggctctgggtgctcggtcagcccctccctgcccgcactggccaggccctgacaccctggcgtctgctcctccacccaggtgaaatctgaacggagcagaaactctcgcaagtggtgccgccgccggggcatagaggagcatcgactgtacgaaatggccaaccttcggcgccagttcaaggtgaggctcgggaggaggggtaaggccggccccactcaggcagacgtgtgtaagcacactccagaacactgcttccccttcccggacagtggtcagaccagaatcccaccctgcacccacctcccccaccacccggtgaccaggtgttggggcagctgggcagagcaaagggagcagaaatccaggagggcttcctggaggggtggaccgagtcagtggacatgcagcatcctcgggaagagctcgccctccggactggggatgctgagctggctgcatgggcatggtgttggaggcagcctacggttgtggttggccggcacatctggagccagacacctcagccacagatcccagctctgccatttctgacagcgtggccccgggtgtgttactgcttgtctctgggcctcagcttcccctcgataaaaagagaggataaaaatagcacttgccagccgggcgtggtggctcacgcctataatcctagcactttgggagggcgaggtgggtggatcacgaggtcaggagatcgtgaccatcctggacaacatggtaaaactccgtctcttctaaaaatacaaaaattagccaggcatggtggcacgtgcctgtaatcccagctacttgggaggctgaagcaggagagtcgtttgaacccaggaggtggaggttgtggtgagccgagattgagccattgcactccagcctgggcaacaagagcgaaactccactcaaaaaaaaaaaaaaaaaagatttgggtttctcctgcgcccacacagttctgcagcttgtttcatagatactgttctccatctgagtgcagacagacctgctgttaggtccttttccatggttgtatccatggattgagaatagaataaaagggttcctggtgtaatccattctgtttggttggagatgggcaagctgaggcccagagggggcagtcacccagccgacacctcctgtaccatttctggggtcccggtgttggggaccacagatgccccgaatgctctgagcatgggtcccgagttctctctggctgctagagcagtgttcaggcttcattggtccccagatgctttgagaatctaatggaaagtgtgagccctttgcacccacatgcacacatacagacacacatgcacgcacaatctcctgtgtcctccatcggtcagggctcagcaggaaacagaaggtccaaccaaattgggtcacttgaggaatgttgacaagatgtgggcacggggagggcaggggtctcagattttatgggtcacaggcagctggagggtctgttgggtccagatggccaaccccgccgagccccctcctctctccacttggtcgttctgggatgaggcccaggacttggcattcccagcatgtgcctagatgccccagggctacactcagaagcactagtgcaggacgcccaccagggctgtgtgggaaagcagggccccccagacccaaggggcaggtggggcagtcagcagagcctggagccagctgtgggaaaaggcactggacgcccgcacctgcctcctcttgcccctggccccggtgttccctccactgaccagcgaggacagctctctctctggagcagcgatccatgcccagcaccatgcgaggggctgttttcagccccctttgggcactagcagccctgccactgggagggtccccatttccatgagtccagagcccactgagtctgccctgaggccctcacccctacccacctgcccctaggagctgttggaggaccacgggctgctggctggggcccaggccgcgcaggtaggggacagctacagtcggttgcagcagcgccgggagcgccgggccctgcaccagctgaaacgccagcacgaggagggcgcggggcgcaggcgcaaggtgctgcggctgcaggaggagcaggacggcggctccagtgacgaggacagggctggcccagcccccccaggggccagtgatggcgtggacatccaggtgggcgccatgggctgtggggtgtgggggtttaccaaggtgggccttggcctctcctggggggtcccaggggacatggccctgtcctcatttcaggagccgggtttccatggacggtgcttggtcccaggtatctgcagagcctgggggtctgcggatcatggtaggagcccctcaggtcccctaagactctgcctccccgtgctccccccaggatgtgaagttcaagcttcggcatgacctggcgcagctgcaggccgctgccagctcagcccaggacctgagccgcgagcagctggctctgctgaagctagtgctgggccggggcctgtacccacagctggccgtccccgacgccttcaacagcagccgaaaggactcagaccaggtggggcctgttctgccccatcctatgttttgtcctccaacacacgaaccctgagtgcctgtcctgtgccgggaatgcagtggtgactgaaacaaccctggttctgtccccatggggctcacaacccagtgggaggacagacccatccccagacaacccagagtgggcagggcttggggagtccagagcactataggagcccacagggggcatctgccccagatttggaggagtcagggagggcttcctggaggaggggacctgggccagagggtggaggagaggcatcctgggcagaggagagagcagataggagggcttgtgctttctctctgtcctccgcagattttccacacgcaggccaagcagggcgccgtgctgcaccccacctgcgtcttcgctggcagccccgaggtgctgcacgcacaggagctggaggccagcaactgcgacggaagccgaggtacagtgagcccaggcggaaggaacccccatccgggatgtgaggggcagggataccgtgaactcccaggcccctctggctggggctcccacaccggcccaggctggtattgacgggggcccacaggaggggaagttccagggccaggcctccctgggtagccttgggtgactcacccctgctgggcctcaccttccgcatggtggtgatagtcaacctaagccagtgtggctgtgcccagagagtgagcaccggtcagggggcctgtcctatggactctgtgagctcccaggtgggtcctgcagagggaggcccccctggcacccgtgtgcatggaagggtgtctcgctgcaggcatggctgcgtgctgggagtcacattcagatttggctgaccttcttgtctgagccaggccaccaaagccatgccgtaagcatactctttctatcgatgtgtactttgaccgggtgggacaggcgggcttctgatgggcctgggtgggccagggtgggcctgagcggtcctcctcaacctttcagacgacaaggacaagatgagcagcaaacaccagctcctcagcttcgtgtccctgctggagaccaacaagccgtacctggtgaactgcgtccgcatccctgccctccaggtgggcctctgccccaccccgcccccatgcccagatatgagagctgcgttgcccagggtggtgggtgggggcaccgcgtgggcttggaggggccacctggcacctgggctggccgcaggcgtcagccttgggccgttgctgtggctgctttttctctcattcatggacttgctcaacagttaacctgccaagtgcctgctgggtgccaggcgctgtgccaggtgccaagggcgcagcagggaaccaggcatgaagcccagcccctgccctctcgggctctagtggcaggggacagtgacagcagtagcacagtgatgccctgagcgatgtgtgggagggtggtgctgggcaatggagagtagggtgggggtgagggtggacacagggtgtggtacaagataaggccacctggtgtccccaggcagagacccaaagaggagagcgtgtggatctcggggcagagtgttccaggcagtggggtggcctgcacagaggctccgaggcagacatgtgcctggcgtgcagtcagcaagggagagcgtgtggagatgaggccagagaggcgagggagacaggaccctggggacttctcagcagagctgggacagggtcccagccaggagggctggcagctgccaggagggagaggagggtgctgccccggtggaggctgaggccgaactcagatcatggatgcccttgcatgggcaccggcagcagagccatgggccccatggcagccactgccctgcccctagtgctcctcgagcgtctttgtgatcctaggcctggcctcggagtcctcacgcagccctgtgggtctccctttatagaggggactgaagctcaggcaggggcggggatacgtcacctaagtcacacaccgagcaggtggccaagccagagctcctgggtcacactgccccctcctgcctcctggctcactaccagcactccccggcttgggtcccagggaacgtggaggggagagaggaacctgcaggctcctagagcctcagggttttgttgacactgcgattgccaccaacaccacaaaagccagctcagctcagtcacttctgtgcgtgtccacacctccctcgagcccgtctggtgggccaggcactgttagtgttctggggccgggggtgcagctgtggtcaatgtcaaccaaactccccaccctcatggggctcagataggatggtagaggcagacggcaaaccaaaagggtgatgccaggtgctcatgtgagcatgggaaagcaggcagcacgcaggccgagggacagaggattggcgaccagccgggccgcaggaagcggaacagacctgctacctgaggcgctctctccctgcactggactgcttgttgagagaacctggccagctcacacctggaatcccagcaccttgggaggctgaggtgggaggattgtttgagcccaggagttcaaaggcagcctgggcaacatagggagacactatctgtctctacaaaaaattttaaaaagttagctgggcgtggtgttgtgtgcctgtaatcccagctactcgggaggctgaggcaggaggatcgcttgagcctgggagattgaggctgcagtgagctgtgattgttgacactgcactccagcctgggtgacagagtgagacactgtctcaaaaaataataagccgggcatggtggctcacgcctataatcccggcactttgggaggccgaggtgtgtggatcagttgaggccaggagtttgggaccagcctagccaatgtggtgaaaccccatctctactaaaaatacaaaaattagccgggtgggtggcgcgtgcctgtaatcccagctactagggaggctgaggcaggaaaatcgcttgaacctgggaggtggaggttgcagtgagccaagattgcgccattgcattccagcctgggcaacagagtgagactcatctcaaataaataaataaattaataataataataagaagaagaagaagatggagaaacttcacattcacataagcaggcagaacagtatatggagccctcctgtaccatccccggtccccaaaccatccacgcatggccagtcctgccctttcctctgccctggccccagccctgaggattttccccaacatcttatgagccacagcactgctaattacagcgctgacttccgtcctcacagaggagcgtgtgctcagggtctgggctctccctgcacgtcgtgtgtgtctgagtgcctgctgtccctctgccaccctgcctgagaatgcagctgtctctctcccagcacgctcccatctgccgccccgccaccccagcccccttccctgactcagcggctgccttgttcatgccgtatccccagcacccgaaggggtgcctggtacagcgggtagatggcgggtaggtggatgcctcacatagacagggctggtgggtgggcaggagcccagccgggcagggcctgtctccaatagcgccctgcccctcccacctactccctgtcttctgccccccctctttcagtccctcctgctttttagccggtctttggacaccaatggtgactgctcccgcctggtggccgatggctggctggagctgcagctagcagacagtgaaagtgccatccgactcctggcggcttccctgcggctccgtgcccgctgggaaagtgccctggaccggcagctggcgcaccaggcccagcagcagctggaggaggaggaggaggatacgccagtcagccccaaggaggtggccaccctgagcaaggaactcctgcaattcacggcatccaaggtaccctccaccagggtgcccgtgcctccctatggccagaaggggcatccgtcactgggcttgagcctcgggaaggcctggcttcccattcactccacatgggcacatttgggggttttcaggccacagaggttcagtcacttacacaaggtcactccactggtctgggtggagctaggatttgatcccaggagcctggttccagaggccacactacccactgctgccttgtttactaagcaccttctgcaagcgtggctgatcccctcttgctaacagtaaaggacaggcagggtgtgagagggaagccgtagacgtctgcttgtggatgggaagaactgaactgagcagacttgaaaccagcccctgactcttaggtggggagtggaaattgctcgtggttctacttcatgtgggtggggtggggagaagggtacaatccaggctgacttcctggagtagaagggcttgaggacaaaggagcaggaacccagtgagccatggagaggggaccaaggctgacatgctaggaggaggaggggggaggtggccagacttgaaggttagactcaaggtctgaatggggtcccaccagtgacaggggcagaagaggggcctggggagggcaatttagatgggggtgggttatcaggtatattctagacagacccctggtcatgtgtgtctgcagccaaattgtgattggtgtaagcacttggctcccgtaactgcaaagcccgagggagggcttcaggcacagctggatccaggtgctttggcggcatctccctgagtctgtctctctccatttcctgtctctccttccttagattccttacagcctccggcggctcacagggctagaagtccagaacatgtatgtgggaccccagaccatcccagccaccccccatcttcctggcctctttggcagctccaccctgtccccccaccccacaaaggggggctacgcagtcactgacttcctcacctacaactgcctcacggtaagcatgaaccctccttccctgaaggtgggatttcaggaagaccccaccaccccgtttcaccttagtccagggacatagttcccaagtggggcccgtggccctgagggcttctgggaagggtcccgggggggcacttgggtggtgggtggcacttggcgggggcccagccctgacagctggcctgccacagaatgacacagacctgtacagcgactgtctccgaaccttctggacctgcccccactgtggcctgcatgcgcccctcacgcccctggagcgcatcgcccatgagaacacctgcccccaggccccacaggatgggcccccaggtaagcacaggactgtggggacccggccacctctgcccagccgtctgcccatcccatgatggtctcctgtgcgtgtgagcacttgctagagcttcgaggactgacgacctccacccgctggccctggctggtgccacacacaggccttgtcctgaagatcaggagcccaaggcagggagagcctggagcgccacctctttctgtctgcctgtcccctgtggtgtctctgtgttgctgtctttgtctctgtttctgtctctctgtggctatgtctcttgttatttttctctgtcctgcagctatctctgccttggtcacctccaccctgttgtcacccagggatgccacacactggggttcagtgggggagatagcactggggccacatgcctccatccccggctggctgtgtctgcctgtcagtctccatgtctctccttgtgtctttctctctgtctctctcactggcagggatgcggagtaaagacagacctgtgtatttttattaatctgggagggcttcctggaggaggcaaaactgggttctccaaaggccaggagagaacctgagccccacaggtgcctggcatttgggtgcgggtagacctgtgcactggaacacgcccctcacagcctcctccttttcctcccttaggggctgaggaagctgccctcgaaaccctccagaagacatctgtcctgcagaggccctaccactgcgaggcctgcgggaaggacttcctctttacacccacagaggtgctgcgccaccggaagcagcacgtgtgagctgggccaggagccctgcccacctccgtgcagctgacctgccctccagcccaggactaggggcaggactcttgcctgaacccccagcctgggcttagccctgtggtcctgtcccagtgcagagggcctggagcacggattgtgaataaagccgcacatgctgatacacactgttgttaggcctgcacctgcccatccagaaagcagcagctgccttgttagtcctccccagggtctagctttccttcttcctgctgcagggtgctgcctgaggggtcctgggtaggaggggcgttagagccagcagggacctcccatgtctccagattccaggtgcaggttcttagcacctccgcagccgctctctcttgagtccatcctcagtctctccttccccttgaagtagggggaccctgaatttgcccatccacctgggtcactttgagagttgtgcaggggggctgggagcactggtgttcacgtgggaccacaggctgcaccataagacccactcacaataaaaaaataaaaggccgagccgggcatggttgctcactcccgtaataaaaaaataaaagaacaggctgagccgggcatggttgctcactcccgtaatcccagcactttgggaggctgaggcgggtggatcgcctgaggtcaggagttcgagaccagcctggccaacatagtgaaaccctgtctctactagaaatacaaaaacttagctgggtgtggtggtgggcatctttaatcccagctactggggaggctgaggcaggggaatcacttgaacctgggaggcagaggttgcaatgagctgagatcatgccattgcactccagcctgggcgacaagagtgaaactccatctcaaaaaaaaaaaaaaaaaaa

SEQ ID NO: 13205 - DNA, 640 bp, Homo sapiens; identical to SEQ ID NO: 11944

SEQ ID NO: 13206 - DNA, 640 bp, Homo sapiens; identical to SEQ ID NO: 11945

SEQ ID NO: 13207 - DNA, 571 bp, Homo sapiens; identical to SEQ ID NO: 11946

SEQ ID NO: 13208 - DNA, 640 bp, Homo sapiens; identical to SEQ ID NO: 11932

SEQ ID NO: 13209 - DNA, 639 bp, Homo sapiens; identical to SEQ ID NO: 11948
  misc_feature (88)..(88): n equals a,t,g, or c

SEQ ID NO: 13210 - DNA, 397 bp, Homo sapiens; identical to SEQ ID NO: 12849

SEQ ID NO: 13211 - DNA, 648 bp, Homo sapiens; identical to SEQ ID NO: 11949

SEQ ID NO: 13212 - DNA, 434 bp, Homo sapiens; identical to SEQ ID NO: 11950

SEQ ID NO: 13213 - DNA, 624 bp, Homo sapiens; identical to SEQ ID NO: 11951

SEQ ID NO: 13214 - DNA, 509 bp, Homo sapiens; identical to SEQ ID NO: 11952

SEQ ID NO: 13215 - DNA, 654 bp, Homo sapiens; identical to SEQ ID NO: 11953

SEQ ID NO: 13216 - DNA, 380 bp, Homo sapiens
aggtgccgtaaagcactaattgggaacctaaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 13217 - DNA, 546 bp, Homo sapiens; identical to SEQ ID NO: 11954
  misc_feature (20)..(20): n equals a,t,g, or c

SEQ ID NO: 13218 - DNA, 654 bp, Homo sapiens; identical to SEQ ID NO: 11941

SEQ ID NO: 13219 - DNA, 112 bp, Homo sapiens
tttttttgagatggagtttcactcttgttgcccaggctggagtgcaatggtgcgatcttggctcactgcaacctccgcctcccgggtttaggtgattctcctgcctcagcct

SEQ ID NO: 13220 - DNA, 3471 bp, Homo sapiens
taggattggatgatggttagtaaaccttatagaatactttgcttagagtttcatggaatgtcccagaagtttaccttagtctggacccacccccagtctgaaccttctggaattttctatgtaccccagattcgggggctcacagggaacgttcctggctgggatcttgactgagaaaacaaacttcagaggtctatctcaaggagcccatgctattagaccactagtgctttacaaacccacatcgaaaggaggccacctgtttcactagaacaaaaagcccttgccccactgtttctgtcgtgcctgctttactggttgagaagcactagtttcagaacattttgctaaactccacttcgtgcagtttgtttttccagaaaaaagaaactccacttgctgcagttttgtttttccagaaaaaagtctctgtcctgttttctaaatatgaaacatagtaacaataaatgttcttttaaaaagtacatatccccttcccccaagtccaggctcactgagccaaacaggtctgaaccagattgggctcaaatcttttttttctttttctttttttttttttttgagatagggtctagctttgtagcccaggctggaatgcagtggcaggatcgcagctcactgcaaccacgacctctcaggctcaagcgattctcccaccttagcctcctgagtagctgggactacaggcacttgccacacccggctaatttttgtgatttttgtagagatggggttttgccgtgttgcccaggctggtctccaactcctgaggtcaagtgatccacccgccttgggtggatcccaaagtgttgtgccaggccccagatcttcattactgcatcatatgatcactgcaaagcctggagtaggggcatacccccaacctccgaggcaagagacaatcaatggtttccctttttttttttccttttcaggctagattggcacaatgatggaatggttttcaagaggccaagtaggaccagctgtgggtttatcccattttacctaaggattttacacaatacattgagtgcaggaatggcacgcaatgattgcactcagtaatataccaaaccactcctggctttgtttagaccctagacttgggccctcatccttctcgtagacctcttgcgaggattttccccttttacagattcacactcagtcccgaacagaaacacttgagcacctacaatctcacagccaactccctgccaacgtccagtgactcacagttaagagagcttcagcagcagctctgaccaaagtgatgaccaactacttaacatgaattagaaacagagcagaaaaaacacgcctttagcctgctctgcgtaaagaaccaagtctccaccatgaacaccaagccaccaactccccgtccctcagtagtcctgtgtactcccaaagccccaaaatttaccccagcctcaagcagccttgtttaaaaaattaaggaagggcctgtgataagcactgcaagttaaacagaaacaggggacttaagtgcagagtttgtcactctatttctgggaggggatgggctgcacagtgtgcaatggggctggctggtaaagggaggaccaggtgacagccagccacactgtctcaaggatgaacctggccctgctagcattatgctgtaatccctgtggattagaactatggataatagggccgggagcagtggctcatgcctgcaatcccagcactttgggaggctggacgggcagacagcctgaggtcggcagttcgagacctcagtctggccagcatggtgaaaccccgtatctactaaaaatacaaaacactagccaggtgtggtgggagcctgtaatcccagttacacaggaggctgaggcaggagaatcgcttgaacccgggaggtggaggttgcagtgagctaagatcgcaccactgcactccagcctgggcaacagagcgcaagactccatctcaaaaacaaaacaaaacaaaaaaccccccaaaaactatggataataaagcatgacagacctcaagatgccaaatgattttctcctctgctgtcatgcctacagagtaacttctccaaggtcacacattaaatatgggcacaggaacactcattccttatgctcaatgactttttctcactcctacatgctatcaacataaggaggagtgccccagggggctgaccttagcgggaggaacgacaggctctccaccgatcccattcttaccctggaccaggtctcacctgcggcttggggaagtcacagaaagacaagtttcgtacaaccccagaccttttcttttggtagtcaacaattggtcacattgcacatttcaaggttacagaggcccaccatacacatgcggggcaggaggagataaatcttgcttggggctaaacaataaagctacagcgagtgttccagaagttgaccacatctggaagcaagaagacagactctggaagaagcaccctagagactccaggaacccccttcactcctgggctttcgggactctacagcgtggggcctctttctcagacatcgaaaggcctccttttctggaccacagtggagcgatgtgcaggtcatcggctaagctgggcgggtcggggagggcagggggagtacagttccttcggatcccagcaaaggtagactatcaatggccaagggttcagaggcaggaaaaaaggccgtttctggggggttggctggggacactccccttcccttctctctccgattaaatataaaagccgatgatgatgaagattgaaaagatgaggaaaatggcagccgtgtctcgggtatcctcccagcggaggcctttcatggaccgatactcctgccgtttgcgaagggcctcccgccgggccctcaggcgccgttcccgctccagttgttccccgtagtgggcctggtagaaggcgtcaaagttgaacatcgtgcggttggcgccgggggaggcccgagaaccgtcgtgggtccgagaggtgggcggcggggtacgcggcgagccggggtcgggtgcgggcgtcctggagggccggacgccaggtccgcgcaggtcctcgtcgctgagtaggccgcgatcatacttgcgacggagggtggcactgcccagcaccacgtaggcctgggagatgcgcgtgaagcgctcggcggcctccgcgctcccggagttgcggtccgggtggtagagaaagcactgacggtagtaagccgccttgatttgggcctgcgtggctgtggaggggacgccgagcagatcatacagcgccgtgcgcgaatacgagcagtcgccctgggaataagtcctcgctcctaggcccaggctgggtgcagaattttgtggaaagccacgggcctgcagcaacctccaaggtaacagccgctgccaccatcgccagcgcatggctgccatgttgaattgattcggcag

SEQ ID NO: 13221 - DNA, 359 bp, Homo sapiens
gcagttttatgacgagacagaagcccggaaatacgttcgcaagtgaggggagcctgaatactgcggggcgtccgggggtcgggaagcggcaagttgcccctgttgctggcgttgcccggaaaggccgtagaatttgggggtgcgggaagggaaggacccgggtgggtgccgatttctgtctctggtaaatcaactttaagttgccgacctctctgggcctcggtacctcagcgttgaggtaggggtgatcgcgcttgctttccgtgggtggttttcaaagtcgaatgtgacaatttgtcctaaacatgtggtaaaagaggcgctgggcggtgggtacgggcgaggggtcagtcctggtg

SEQ ID NO: 13222 - DNA, 573 bp, Homo sapiens
gggcaacagaagggaaaaagcagtttggctcaggagaaataaagtcccattcaagcccaaagacaccaccacaattacctagacctgtgcgcctttggttcctgtcttgtggcctctgtctccccatttaggaaccacgcctgtggctcactcggcctcgtgctataccagtaaccccctccccaccccactgagcacagcctgggccaggctgggcccctttaccctattctcccatcctaggtccaaacttctagggagttttgtttcagtttgtgaaaaagaaaaaggattaaggctgggcatgtctgagccatcctccacaaccaggaattatggaatagcccctagaaggcaggggctaaggtcatggccgagttcagcctccacttgccaggtagcagcagagaaagaaaagactcaagccaatctgagtgggtggggggaaaatgtgaccatgggaaccttttgggggtccttcaaaaagcctcccacacattttcctttccatgaagagcacaggctcagtttcagggcaggcagggagtggggtccctcaggcattagctctgg

SEQ ID NO: 13223 - DNA, 835 bp, Homo sapiens; identical to SEQ ID NO: 12730

SEQ ID NO: 13224 - DNA, 3929 bp, Homo sapiens
gagaaacacaacactgtttctgcgtcataacaaagatctagttgtgcaaactgcacagccagaccaacccaattatggttttcctctggatctcttacgctgtgaaagccttcttggtctggaccctgcaactggcagcagagttctaaacaaaaatacacactgcttgtttccatggcttccctcaccatgaaatccggcctgtcagcagctgcacccctcagcatattggaccagctatcccagaagtcagctctgtctggtttaaacagtacatttacgtttatcatatcactggacaaggaccaccatcccttttattatccaaaggtacaagacctcgaaaactgccagatatatttcagagttacgatcgattgctaataacatcttggggtcatgatcctggagtagttcctacctcaaatgtgctcacgatgttgaatgatgctttaacacattctgcagttttaattcaggagcatggtctgcatgggataggagaaactgtccatgtcccatttccatttgatgaaacagaactacaagaagactcgtgtcaatatgggtgttcataaagcattgcagatactaaggaacagagtggacttacaacatctctgcggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccactgttcagttccgaattaaaccggaaagtatatagaaaaattgctacacatggcctttgcagaaaagagagccttcaaaaacctcttacattccagtagaaaactctctctgcaagtccttaactttgttcactcattccaggaaggtgcttcaacattggatattcacacagagcccagtttttcaagtttgctttcacagtcatcgtttgctgacatgggtgttccacttcctgcaaaaaatttaacatttaaagatagtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgcggagcaattcttgctttactaatattaaaagtttggggaacatattcatgttttctgaagttttgctccttattgcacatcttattgcaacaaagtgctttttagcatccagcactgtatttttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcagttggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcaccctgatttatttttttgtttcttacctttgatgttttcaaaccaaggattgtgattttaggttagaattacatattagaagcattaagactatgtctttggatcagaatgctttagtgattaacctactttgaagacatactcttaagcaatctggatcttaaatttatgtgaatacatttttagaaaatgataaagaaaaatggaattacttcaaagtgtttcttgagtcattgattcttttagcatctcaaatgttaattagaataattggaatcactttttagacttttcaagttacctttcttgggaagtttgtgtagtgttaacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtatgtatgtaacttttacagtttttcagctgaaagttgtatttttttttaatcagggctctttaatctcattttaatttcctttgtttgaatgaactgtagttattttctgtattcctatattaaccatctaaaccaactgtaatgacacgtacactaataaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatggggtcccctctggtttcttgtgttgaatgaggcaagagtaatcatctgattctgagctgaagacctctcatactctcaaggagggagagtgcatttttagagcttttagcaaaaatgtgaaaagttcatgtttgcacgttgctttgtgaatttggcttccttttacttatacattaactcatgtaatgtcttaaatcttacaagtattgatccatttcaacaaaaaggtaaatttaaaatgcagactttgttacttgccaaagaagattcatgaaaaatttatatccaattattttccaaatagttaatttaatttggctttttaccacattccttcctttctttcccgacttctttaatgtaatttaaatcctggaaaacattctttagaaaccaagaggaaaagaagaacacataccaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcggaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacatgtttacaattaaactgtggtgttgatcaagttaaaaaaaa

SEQ ID NO: 13225 - DNA, 3928 bp, Homo sapiens
gagaaacacaatactgtttctgcatcataacaaagatctagttgtgcaaactgcacagccagaccaacccaattatggttttcctctggatctcttatgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttatgtttatcatatcactggacaaggaccaccatcccttttattatccaaaggtacaagacctcgaaaactgccagatatatttcagagttacgatcgattgctaataacatcttggggtcacgatcctggagtagttcctacctcaaatgtgctcacgatgttgaatgatgctttaacacattctgcagttttaattcaggagcatggtctgcatgggataggagaaactgtccatgtcccatttccatttgatgaaacagaactacaaggagactcgtgtcaatatgggtgttcataaagcattgcagatactaaggaacagagtggacttacaacatctctgcggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccgctgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgcggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcagttggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaagcattaagactatgtctttggatcagaatgctttagtgattaacctactttgaagacatactcttaagcaatctggatcttaaatttatgtgaatacatttttagaaaatgataaagaaaaatggaattacttcaaagtgtttcttgagtcattgattcttttagcatctcaaatgttaattagaataattggaatcactttttagacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtgtgtatgtaacttttacagtttttcagctgaaagttgtatttttttttaatcagggctctttaatctcattttaatttcctttgtttgaatgaactgtagttattttttgtattcctatattaaccatctaaaccaactgtaatgacacgtacactaataaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatggggtcccctctggtttcttgtgttgaatgaggcaagagtaatcatctgattctgagctaaagacctctcatactctcaaggagggagagtgcatttttagagcttttagcaaaaatgtgaaaagttcatgtttgcactttgctttgtgaatttggcttccttttacttatacattaactcatgtaatgtcttaaatcttacaagtattgatccatttcaacaaaaaggtaaatttaaaatgcagactttgttacttgccaaagaagattcatgaaaaatttatatccaattattttccaaatagttaatttaatttggctttttaccacattccttcctttctttcccaacttctttaatgtaatttaaatcctggaaaacattttttagaaaccaagaggaaaagaagaacacataccaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcagaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaa

SEQ ID NO: 13226 - DNA, 3928 bp, Homo sapiens; identical to SEQ ID NO: 13225

SEQ ID NO: 13227 - DNA, 9903 bp, Homo sapiens; identical to SEQ ID NO: 12728

SEQ ID NO: 13228 - DNA, 379 bp, Homo sapiens; identical to SEQ ID NO: 13183

SEQ ID NO: 13229 - DNA, 379 bp, Homo sapiens
ccaataaagccagtggaaattgccatagaggcatggtgggtggtgcaggctggatatatcacagaagatgacatcaagatatgcacttggcctgagaaatgtgctactgataagatcgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaa

SEQ ID NO: 13230 - DNA, 379 bp, Homo sapiens; identical to SEQ ID NO: 13229

SEQ ID NO: 13231 - DNA, 163 bp, Homo sapiens
gggattacaggcgcctgccaccacacctggctaatttttgtatttttagtacagacagggtttcaccatgttggccaggctggtcttgaactcctgacctcaggtgatctgcccgcctcggcctcccaaagtgctgggattacaggcgtgagccaccgcgccc

SEQ ID NO: 13232 - DNA, 115 bp, Homo sapiens
  misc_feature (57)..(57): n equals a,t,g, or c
taattttgtatttttagtggagacagggtttctccatgttggtcaggctggtctcanactcccgacctcaggtgatccacccacctcggcctcccagagtgctgggattacaggc

SEQ ID NO: 13233 - DNA, 117 bp, Homo sapiens
taattttgtatttttagtagagacagagtttctccatgttggtcaggctggtctcaaactcctaacctcaggtgatccacccacctcagcctcccaaagtgctgggattacaggcgt

SEQ ID NO: 13234 - DNA, 141 bp, Homo sapiens
ccaccatgcccagctagtttttgtatttttagtagagacggggtttcaccatgttggtcaggctggtctcaaactcctgacctcaggtgatctacccaccttggcctcccaaagtgctgggattacaggtgtgagccaccg

SEQ ID NO: 13235 - DNA, 1160 bp, Homo sapiens
taattttgtatttttagtagagacagggtttctccgtgttggtcagactggtctcgaactcccgacctcaggtgatctgcccacctcggcctcccaaagtgctgggattacaggcgtgagccaccgagcctagccctgtttaggctttttatagcctatgttcttatgagcagtaaacattatgatggtttagttagacctgttgaattgaattcacttctcctgcctgtggtcaggtatcaggtagcacagccacagaagttactgaatgtctttgttggtggactttaggagagtggtttaatttatgtggtattctatctgggattgcagcagtattgttagattgcattttgtcacagggaggaaattacctggtaactcctgattcaggaacaaaatgaagcttcccctttttacaaatcctggctaacattccatttggctctcttctgttgaccacctctctctctcccctccctcctcactccattttctcagttattttattgtttactattggaagtcacctcccaactcaggatacttgttagtccattttaggaaaaatatcaccattctttcactattattctctgttgaagttgaagaacagaatattactttttttctttccattattggttacaccagctagttagagacttggggtaatactgtgggcatgggttggatcctgatatctgtgtcagttagtgagagttggttctatgaccctagagctctttgtgtccttcaaacgagggtgctgaaacaagacgaacatagaactgtctataccaagcaaaaaactcctgaaagcacatgcccactgcaggtgaattggtagcatagtgtggagataagtgggcagtgcttggtcctgtttctgcctcctagagagtacctctcagcatccagggatgctttagtaactcttagttaaaacgaaatgaactataattaattacctttcttttgggagggacacagagagtttcaacagcatctacaatgctttttttttttttttgaaaagaaaatatgatagaatattaagattgacagagctggggatgggttggaggctgaattatgatgtgtgttttctttatgcttgaattatttcataattaaaaacaaaacatataataacaaaa

SEQ ID NO: 13236 - DNA, 94 bp, Homo sapiens
gctgaggcaggagaatcgcttgaacccgggaagcagaggttgcagtgagccaagatcacaccactgcactccagcctgggtgacagagccagac

SEQ ID NO: 13237 - DNA, 1953 bp, Homo sapiens
ggcatgggggtttacttttgcagagctcagaggcacccccaggccctgtctgcttctgacgggccgtaccctttatttcctcctctgtttcatttggctcccagtggctgctctgcggttttgatttccctccagctatggcactgaattcatttatggaaagagacccaccacctaattggcggatgtgcttgggcttctgggtgtggcttccttcttgctgtcataagatgctggtggtgacctgcacatttggccactacctcccgctggaatccagccaccatctgtgagatggggcatgacgcggtccagtggagggtgcgtgctggagtctctcccgtctccaccacctttgttacagatgttctttccgaacgtaggtctctgccgtctcttacttgtttaaaacgcccagaacccgagtcagccttggcagtgagcttacggcccgcaccaggaggggccagcctgctgccaagatggggacggttccctgggccccgcggtctgcggtgccgcctcccacttcaccgcacggtgctctctttcccccaccccccctcagaagcgccggcatattccagaggagtcaacaaacaaatggaagcagagggttaagacagccatggcgggggtgaaattggtacttttctattttgcgggcagcgcgcgtcttgactgtttgcaggcaatcaaagtcgattgtgtttttcctcaacaaactgttgtatatatttttttttaacattcacatccgtgtttctctgtcttccttcggcacccagtgagcccagcatgttgcgatggcactgcatggctatggtgggtctgcggtggcggggacgggggtggggctctggcttgacttggagctcgtgaaacgtgcttgtcacaactgcctgcaagtgtttcttggtctcctcgttaacatgcatgccacccaccccagaacgagtggcctccggtgtcatgcccgtctgcattctgtgacctaatacatgcattttcccatggaaaaatccacccccatttgaaacatcccggattagtgatgagcttctacctagggtttctccagaccaagccaaccctgggttctgagagccttcaggacatgtgtcaccgcagacgacgttttaacttgtagtgctagctgcttgtttcaacttgctccacaaaggaaaaataactattatggtctgggtggcactgggaaaacatcttccatcttctagacctagaagtgagacttttagctgaagaaatggactccaagtccaggtttctcccagacgtgggtccaacagtctttagaaaggcagctggcattacaatgtcctacacacagaggaatcacagtgttaaacggttcttgctcccgttatcctgtgacataggtgataaaccccgaaatgcttcttggaaccctatgcgtttgcactggctcatcacctgtgggcattttgaggtttttctgagtatttctgttgttcaagttgtccctgggcccatgcacgcacgcacatgcacccacgctgacacacagagatgtctcatcgtgatggttccagacagtgaccggcattgttttgtgttgtagactgacaaagtgaagctgacatggagagatcggttcccagcctacctcactaacttggtctccatcatcttcatggtaagttccagaaggttaaggccagacgaagtcagggaaaccgcaaggaagtgattggcttcagccgggcgtggtggttcacgactgtaatcccagcactttgggaggccgaggcgggcagatcacttgaggtcaggagttcgagaccagcctggccactatggtgaaacccctcttctttctgtggatcgcccaaaatacctggtgtggttgtgcaagcccttagtcccaactaatcaggaaggcttagagcaggaccattgccttaaccccgg

SEQ ID NO: 13238 - DNA, 299 bp, Homo sapiens
tttctttttttttttttttttttttttgagagggagtctcgctttgtagcccaggctggagtgcagtggcgcgatctcagctcactgcaagctctgcctcccaggttcacgccattctcctgcctcagccttccgagtagctgggactacaggtgcccaccaccacacccagctaattttttgtatttttagtagagacggggtttcaccgtgttagccaggatggtctcaatctcctgacctcaggtgatccacccgcctcagtctcccaaagtgctgggattacaggtgcgagccac

SEQ ID NO: 13239 - DNA, 424 bp, Homo sapiens
agtacatgagatgatttctgtggtccctgatacacagctttcattttgagagacacaattatttgagtatctagtaattcaagcctgggattcaaagatatcatttaagatgaaactgaagactttttaagaaaaccattaaatgggccgggtgcagtggctcacacctgtattcccagcactttgggaggccgaggcaggaagattgcttgagcttaagagtttgagactagcctgggccacatggcaaaaccaaaaatacaaaaattagctggcgtggtcgtgcgcgcctgtggtcccagctattcgggaggctgtagtgggagaattgctggagactgagaagtcgaggctgcagtgagctgtggtcacgccactgcactccagtatgggtgacagagcgagaccctgtctcaaaaaaaaa

SEQ ID NO: 13240 - DNA, 7925 bp, Homo sapiens
gaggcaaccatggcgggaggaatgaaagtggcggtctcgccggcagttggtcccgggccctggggctcgggagtcgggggcggtgggacagtgcggctactcttgatcctctccggctgcttggtctacggcacaggtaccgcccgggcagcagctgccaagggggcaggtgccgagggggttatttttggaaaagggattgtcccgagggcgcgggccgttactctgcagaagggcggtggctctaccgagggccgccggcgtagtgtggtggaagaaacttggcaggctagtgggcgtcgggactgagggtctgggccctgaagcgggctggggcagcttccagagtggggaggagcctgaagccttttggcggagacaggaagggaggcctagactggttgagaagcagtcctgggggctgtgtctcgttgcagaagccttgagtttcttggttaaaagcgagaaaacctggggaccattctgggcaggcagagcagccgcgggaaagggaccatctcattcattcggcaaatcagcaaacaccatctgagcgtatgctctgtcaggacgcagggcacgggtggcagaacggatgtagttgacagaaatgcagtgatctctactatcttctgctcttgtaaaaccttgattccttaccgcccccggcccgcgagatggagtctagctctgtcactcaggctggagtgcagtggtgcgatctcgctcactgcaacctccgcctcctgggttcaagcaattctcctgcttcagcctccggagtagctgggattacaggcacccgccaccgcgcccggctaatttttgtatttttagtagaaatggggtttcactatgttggccagggtggtctcgaactcctgacctcgtgatccatccgccttggccctcccaaagtgctgggattacaggtgtgagccaccgtgaccggccaaataatgcatgtttattttagatgatttggcaaggtacaattaagtataaagaagcaggcagaaaccacactgttaatccattcagaagcaatctattttagcacactttcttctgatctttttccacatatttttaattttttatgaattgataatttgtatccagttagtactctagttctcttccctggaggctgccagtcgttaccagagatagttttctcgtttgattttgtagtacaataattttcccaagtaatttaaaattctttttttgtttttttgtttgtttgtttgtttgagatggagttttgctcttgttgcccaggctggagtgcagtggtgcaatctcagctcactgcaacctccgcctcctgggtttaaatgattctcctgcctcagcctcctgagtagctgggattacacttgcccgccaccacgcccggctaattttttttttttttttttaaacagagtctccctctttcgcgcaggctggagtgcagtggccagatctcggctcactgcaagctccgcctcccaggttcacgccattctcctgcctcagcctcccgagtagctgggactacaggcgcccaccaccacgcccggctaattttttgtatttttagtagagagggggtttcaccgtgttagccaggatggtcttgatctcctgacctcgtgatccgcccgcctcggcctcccaaagtgctgggattacaggcatgagcctccacacccggccttaaaattctttgtaaatgttgtcttacttgtattacattccaatgtatgtgcagatgttcatttaattttttttctccaccccccgcccgccccgccccgcagaatgtagtcttgctgtctggcccaggctggagtgcagtggtgcaatctcggttcctgtttcaagccattctcccatctcagcctcccaagtagctgggactacaggcatgtgccaccacactcggctaatttttttttttttgagacagagtttcgccctcgttgcctaggctggagtgcaatggcactatctaggctcactgcaacctcagcctccagagttcaagcacttctccctctgcctcccgagtagctgggattataggcgcatgccaccatgcctggctaactttttgtattttttgtacagacggggtttcaccaggctggccaggctggtctcaaactcctgacctcgtgatctgcccacctcagcctcccaaagtgctgggattacaggcgtgagccaccacgcccagccacactcagctaattttgtatttttagtagagatggggtttcaccatgttggctaggttggtctcgaactcctgacctcaggtgttccgcccgcctcagcctaccaaagtactgggattacaggcgtgagccaccatgcctggccttcatttattattttttagtgacgtggttttgctgtgacacccaggctagagtgcagtgcacaatcatagctcactgtaacttcccacctcggtctccccaagtagctgggactacaggcacgtgccatctgcctggtaaaaatcattattaatgttgtggattaaacatttggttggatattggtggtttgtactgttggttggatatttgtggtatttctagtttttcattgttgtaagtttgtgaacatctttgtgtatacatttttatttatttatttatttatttttttgagatggagtcttgctctgttgcccaggctggagtgcagtggtgccatctcggccacctaggttcaagcgattctcctacctcaccctcccgagtagctgggattacaggtgtgtgccaccatgcccgggtaatttttttgtatttttagtagagtgggatttcgccatgttggccaggctggtctcaaactcctgacctcaagtgatctgcccgcctcagcctcccaaagtgctgggattacaggtgtgtgccaccatgcccgggtaatttttttgtatttttagtagagtgggatttcgccatgttggccaggctggtctcaaactcctgacctcaaatgatctgcccgcctcagcctcccaaagtgctgggattacaggtgtgagccaccgtgcctggccttatttttttttctttttttttttgtagagatggggtttcatcatgttggccaggctggtctcaaactcctgaggtcaggcaatcccctcaccttggcttcccaaagtcctgggactacaggcgtgagccaccacgcctgggcccaactatttatttatttatttatttatttatttatttattgatattgagatggagtcttgctctgtcgcccaggccggagtgcagtggtgtgatcttggctcccaactatttatttatttatttatttatttatttatttatttatattgaaatggagtcttgctctgtcgcccaggctggagtgcagtggtgtgatcttggctcactgcaagctccacttcccgggttcatgccattctcctgcctcagcctcccaagtagctgggactacaggcgcccgccaccgtacccagctaattttttttgtgcttttagtagagatggggtttcaccttgttagccaggatggtttcaatctgctgacctggtgatccacctgcctcggcctcccaaagtggtgggattacaggtgtgagccacggcgcccagccccttatttatttttttgagacgtagtcttgctctgtcacccaggctggagtgcagaggcgcgatctcggctcactgcagtctcccctcccaggttcaagcgattcttctgcctcagcctcccaagaagctgcgattacaggtgcccgccaccatgcccagctgatttttttgtatttgtagtagagacggggtttcaccatgttggccaggctggttttgaactcctgacctcaagtgatccgtctgccttggcctccccaagtgctgggatttcaggtgtgagccaccatgcccggctggacagtggtcacttttaaatcttgaattagctgatattaaatacaaattgagaggagaatcttctgttttggtaaatcagagggactgcatgtaatcattgcctgctgttaaaatttgaagtgacacaaaacagctggaaggaaacaaccttgaaatcttttagtatcctccaaaagtactatatattaaaaatattgctggctgggcgtggtggcttacgcctgtaatcccagcactttgggaggctgaggtgggtggatcagttgaggccaggagttctagatcagtctggccaacatggtgaaaccccatctctactacaaaaatacacacacacaaaaaaagttagccaattgagttggctcatgcctgtaatgccagctactcaggaggctgaggtgggagaatcgctggaacctgggaggcagaggttgcagtgagccaagatcgcaccactgtattccagcctgggtgacagagtgagaccctgtctgaaaaaaaaaaaaaaaaatgctggctgggcatggtggcagatctgtaatcccagtgctttgggaggtcagcgtgggtgctttgggaggccaatgtgggaggattgctttaggccaggagttcaagaccagcctgggcaacatagtaagaccttgtctctttaaaaaaaaaaaaaactagctgggtgtggtggtgtatacctgtagtcctggctacttgggaggctgaagtgggaggattgtttgagcccaagagtttgaggctgcaatgagctatgatcacattactgtactccagcctgagcagcagagccagaccctgtctcaaaaaaaaaataaaaaaataaaataaaaaacctgccaattctgttctactcaggaaagggatagagaaaatcaacagatggagtagtttagcttactttattcctttataggacaggaagtatatctagtgtttaagaccatagtcagacctgggggtgaatctcagataggctatttactatttgtgtgattttggagcaaattacttaatctttcttaaacatcagttcctcatttataaaatagggattatgagagtgcttacctcatagcattgttgggagcattaaatgagacagcatactgtctcttttatttatgtatttattttttatttttttgagacagagttttgctctttttgcccaggctggggtgcaatggcgtgatctcggctcacctcaacctccgcctcccaagttcaagtgattctcctgcctcagcctctcgagtagctgggattacaggcatgtgccaccacgcctggctaatgtttttgtattttagtagagacgggggggtttctccatattggtcaggctgatctcaaacttctgacctcaggtcatccgcccacctcagcctcccaaagtgctgggattacaggcatgagccaccgcgcctggcagcatactgtcttaatagatacttaatacaaaaaaaaaaattagccgggcacggtggcgggcgcctgtagtcccagctacaggctgaggcaggagaatggcgtgaacccagggggcggagcttgcagtgaaccaagatagccccactgcagtccggcctgggcaaaagagcgagactgtctcaaaaaaaaaaaaaaatagatacttaatagtagtttttattattacttttctgactgaatgactgtgtaatatttaaataattaaacgacagaaataagattctgccttagttcttccttcttctcagttttttttcttatttctcagtctggctaatgttttaacccaaagtttaggaaaatggttagtttaatctttttcatgaaatgagttatagttattagcttgttatgtttaattcttgtttcctttctttgcataaagctgaaactgatgtaaatgtggtcatgcttcaggaatcccaagtttgtgaaaagcgtgccagccaacaattctgttacacaaatgtgcttatcccaaaatggcatgatatatggacacggatacaggtaataacttggaatcctctggcagtggcagcttctgtaaatttctgttggtgattagtgagtattttgacactttcttccccttcacatgcttaaaaaaaatgttgttaacaatcttgttagggttgagattatcctgagttgtgttttcatcaataagcatttatgcctactttgtattcctctctgctccctcaagtagattacggtattctaaggtaaacttctttcctcctccctccttttcccaaagaaactgctttgttttcttgtccttcattttgcagtatgtgtgtgtgcacgcacacatacccctctttctttttttatttttattttttattttttgaggcagagtctccctctgtcgcccaggctggagtgcagtggcaccatcttggctcactgcaatctctgcctcccgggttcaagcgattctcctgcctcagcctcccaagtagctgggattacaggcatacgccaccacacctgaccaatttttttgtattttttgtagagatggggtttcatcatgttggccaggctggtctgaaactcctgccctcaggtgatctgcccaccttggcctcccaaggtgttgggattataggcatgagctatcgcacccagcccccttctttctttttaaaggccttatgccttctttgggctggaaactgttatgtgcctgtgaggatgtaaactcttttgccccactgttcctattctgattctatatgagatatttcataaacccccgagctgaagaattactttggtctcatttatttcataacactgttaagtcacctggcaaacaggaatgtctggctgtaacagtgattgtacaaaataggtcctttcagaaatgtcgtagttgttataagcatagttactgataaggacatttgttgttcacatcaaaaacataagggtggacttgtggatttgttttttttttttgagacggagtctcgctcagtcacccaggctggagtgcagtggcacgacctcggctccctgcaacctctgcctcttgagtagctgggggccatgcccagccaacttgtggatttttaaaaaaaattctttaaaaaaaatgtctgacaagccgggcgcagtggctcatgcctgtaatctcagcactttgggaggctgaggcgggcaaatcacttgaggtcaggagttcgagaccagcctggccaatatggtgaaaccccgtctctactaaaaatacaaaaattaactgggcatggtggcgcacaccctgtagtcccagctactcaggaggctgaggcagaagaatcgcttgaatccaggaggtggcggttgcagtgagctgaagtcatgtcactgcactccagcttgggcgacagagcgagactccatctcaaaaaaaaaaattatctgataaaaaagtgatactccatctggggcacattataaccaacatttactcataatcagtggcttgtgacaatggattgaactcagcctgtcattacggaaaacatttttagttttctggggcagtttatgcctggcaattttcttaatattatagacctttgctttgtgtgatctctaataaatagctgtattgataactctttcagtttggaagtcttttttccctctatgttctgccctaatagtagattcagatcatgttaacaagaaggtattctaacagctgtctctctgtaacatgtgcagtgttatttgcccaattatgttttagccactgtatttctatatttctgataagctttgtggaaaactggcaccattactgatttggttgttagtctgagggttttttaaaaaattgtatttgtgaaaaattaaaattcctacttccttttttctcatcctgattttatttgtgttacagatccgagtaaatagttccagattggttcgagtcacccaggtggagaatgaggagaaactgaaggagct

SEQ ID NO: 13241 - DNA, 388 bp, Homo sapiens
tgcccccttccttgaattcctcaattcatttggctctatcatctgtagttttcctacccatcaccatcagatcctcttaaaaaaaaagtttcaatttctactaacagtttctgaacacctggatctctgctgggccctgtgttaaatcattgaatgggaagcagctaatccatataaataactccggctttggagtcagtaggatttaggttgggatcacagaccagatgaactatgaaatcttgggcaggttcctgtggctgtcttggctttggcttcttaaatggagagaattatatttgtctcacaagatgataagaggaataaatgaatctttcttaatcctaacattaattttacttccaaaaataaaaatcctatgaataca

SEQ ID NO: 13242 - DNA, 92 bp, Homo sapiens
ggaagggtgcccaggctttaggtgaaatttaaatgctttttaggtgggctgtttgcatttatttttactgtagctgaccaatagtgccaacg

SEQ ID NO: 13243 - DNA, 4944 bp, Homo sapiens
catctacccttcccattttacctgtatgggcagtagctacagactagttatttggtttccttctttggaagaaggtggtgatgttgagaggagagcaagctatattcttttaaaagtgtgtacagatgtttttgctattttgtgttatttcattttgtatttcattcatccattttgtggacgtgtagataaaacgcggtggtccaaaagcatgacagatgtcccctttgcgtttctccttattgttcgcatggacaataactgacagagtagtcctagttgctgttgttttgatctagtcttggggctggggttgtatattattctttcaagtgtgtataaatattgtgccacctttttatacttcattttatacttgtttccttgtatggatgcatatatacttaatgaaaattgaggttcagagtatgacaaatctcttttcccttttccttactgcctatttaggcaatagctaatagagtagtttgttttgttttggggtgtgggggagagtggagtatgtacttaatgtatataaataaacttgctactacattgtattactaatttggttcacactgtgtccttctcatggatgtgaaagtaccaatgaaatgtggagatctcgatgtataacagtctcccattctcctcatcccttattgactgctgggcagtagctaacagagtagttgtcaagtggcgtatttgaggtgagggggagggacggggaaggtaggaaaatgcacttaatgtatatacatgtttttactactacattgtattaattcatcgggtgcccagactgaaaggtacctaatgaaccatggagttccggatgtataacagtctcctcttttccctttcccttattgcccatgtgggcaatacttaagagtagtttgggtttattgaagattttttgctaggagagagaaaattttttgctaggagaggtttcaaggtaagagtatatactttaaacatgtatataaatgtttttgctacttttctgtcactacctttcttaccttgtcctttacatggatatatgaagaaaattgaggttcagcctgtagcagctctcctcttctgcccttcccttagattgtctgtgtgggcaggtgtctaagagagtagttgattagcttcagggattctttggtgggtgttggggtatatacttttgtatatgtatgtacatatttttatttctttattatagtgtttcattgggtacccggtccttcacttggatgtgtaggttcctaatgagccatggagttatggatgtataacaatctgttctccctttacccttttaatgtatatgggcaataattttaaagtagtttggatttttttaagttttgaggggtgggaggggtctaaggcagaatatatcctttttaaaaatgtatatatacttttcattaactatattgtattatttcatgctgtacccagtccattgcttggacttacgggtacctaatgaaacgtggaggtccggatgtatgaaaatctcctcttttcccctttccttattgcctctgtaggcaataattatagagtagtatagatggtttttcttttttatccatctgcctatctccaggaggatggggtgtgcacttttagaaatgtatataaatgttcttgctcctttttcctgttacttcattgtgtgccaaggcctttccatggatacttaggtacgtaatgaaaattgaggttcattctatgaaaaaatctccccttctccccttcccttattgcctgtcttggcaatggccagtagagtagttatttaagggattttgtttttttgtttttttgttttttttttggtaggggaggtggggaatttctgggtttgtcttttttttaatgtatataaaagtttgctagttgttgttattgttgttctttcactctcaacacagttttttgtttggagttgtaggaatcaaatgtaatgagggacccagacccgagagtgtggtaaatattctttgccttcctcagagcctgtatacacaagcaagtagtatgtgagcactacagggcttgggttttggttttttgcttttgagggttttaatgaggagtgggattgttgagaggaaaaggcaagatatataatttttttaatgtatataaatgttttgctcctttttgatgttaacttcattttgaatctggtcctttgtatgaccacttaggtacttaatagtaataaagttgagattgactctatgaaaaatatcccatactccccatccctcattgcctagggggcaatggtagaatagatgtttggtttcttttgggggtgtctgagtgtatatgtgtgtgtatatacacacaagaacacacatatttatatactatacacacacattttaatgtatataaatatttgctacattctgtgtgttatataatgtggtacccagtcctctgctgggacatggatgtacataatgaaacatggaggtccagacgtatgataactctcctgtttcccttccctcattgcctacaggggcaatagtttcatatcttgggttttttattgtttaatttttttttatggggaggggttctttgggtgggtaatagtcagggggaaaggacagtgtctatactttttaaagatgtatataaatgtttcatgttattggttttgtacctagtcctttgcatggatatataggtacctaatgaaaatcgaggatcagtgtatgacaaatctcccatcctcccctttccttattgcctgtgtcggcaataggaagtagaatagttgtgtgttgtttacttacttgtctgttttagagagatttctatttttggtaggggaatattcttaatatgttttcatatctttatttcattttgtagtcttttgcatggctatgtagggacctaatgaaagtcgagtttcataatatgacagctcacttcttttcctacatatttcctcacttagcagtagctagtgtagttattttgtggttattttatttcattctctaggatctattccattaaggatgcaagtgtgtagatgcatatatatcatttgcttctttcttccgccattattttcctttaacacttagtcccttgcaaggggtctgactatacctaacaaaaataaagacctactaaatccctgccatctggctggaaggtgtagcagtgtattaatgtaactaatagcaacaggtgtgcagcagataagacaggagaagacactcagctatggttgagttgtgaaagctaattagatccagcatttcttatgttgattcagattgaatgaggtagtgaaaagggacctgtgcttttgtaaattctagaaaggcaagaggacaatattgaataaagctgtgtttaaacttcattgctcatatatcttttagtaactggtaaaccggcgaagctgataagccaataagagtgctgtctagaacgcatttgcaaaccgttaagagtagcttctttttgaggcctggacttctgattcatctatagaagtctattatgattccatcaattgcatagcttgtgtacctggtagaaattgtgtcttggaatgaccctttcgagttattgacatggctctgatgaatagaacatgagccccaaaactaaatccaaaaggaattttctatctttcatcccccacatgtggcaagacaagttggccctttcttacccagaggtcttttgtgtgactgcatctttctcctccgttctccattgtgtgctttccattttgtctttagtgcctatactgttaggtgttttcttcactggcattcacaaatttaagccattgctgcctcattagccttgtattttgtgtgcatatcatgtatccagacctgtatgttcgctttaagcattcttatatcacactgtctcctcatctaccatatggtaaatgttaaaactccacatttgtctgcatcagggaaaatgcatgggcacacatcctccctccctccctctctgctctcctcccttccttcaggcctcttagcattgtttgttttcccatttctgatactactactccatgctgaagatttgccatattactattttggaaacattgagtgatagaactcctagaaaatttgcaaagaaatgttacatactgtatatcaaactctcagattctagtgttgaaaaagtagcctatactttgctattacttatacctgctgccatagaaaaaaataagtttattcatgacacatttacatttgatcataaataaaagaaaaaagggcacctttttggagttagtcatggtagtcattagtgatatttctgaacagttcttaatttaaaatacttcaaaggaagtaaaggtcatggcttagctgaaggaaatgctccagaaattggactgtgtaaaccatcagtacaataatacgctgtgtatgtatgtgtatataaaatgagaattatggcataattggagcatttgcattaatcaacaaactcacattgagacaaaacttagttttacagctgtcttgattaaagccaagtgttccatgttgctgtgaagaatagcctctttcaaatactttggaaagtagttacttggaaacttgtaaaggtattacatttttatatttaaacacctatagagatcttcaattccttgagtctgagcttgtgggtggaattctaaatttgtatcataatctgtcttttgtgaaacattttgaaaatatgtatatataatattgtatatgcaaattgtgttgtttcacttgtaaagggaaaaggcttatttttctttatatttctgataacttgttttgcatatgaccagcactgactgaaaggcatgtgtagctgcaaacactgttgctttttttgtgaaatgaaaataaaagtatttaaatacaaaca

SEQ ID NO: 13244 - DNA, 2773 bp, Homo sapiens
  misc_feature (789)..(790): n equals a,t,g, or c
  misc_feature (806)..(806): n equals a,t,g, or c
  misc_feature (811)..(811): n equals a,t,g, or c
  misc_feature (818)..(818): n equals a,t,g, or c
  misc_feature (825)..(825): n equals a,t,g, or c
  misc_feature (831)..(831): n equals a,t,g, or c
  misc_feature (834)..(834): n equals a,t,g, or c
ctggtcctttgtatgaccacttaggtacttaatagtaataaagttgagattgactctatgaaaaatatcccatactccccatccctcattgcctagggggcaatggtagaatagatgtttggtttcttttgggggtgtctgagtgtatatgtgtgtgtatatacacacaagaacacacatatttatatactatacacacacattttaatgtatataaatatttgctacattctgtgtgttatataatgtggtacccagtcctctgctgggacatggatgtacataatgaaacatggaggtccagacgtatgataactctcctgtttcccttccctcattgcctacaggggcaatagtttcatatcttgggttttttattgtttaatttttttttatgggaaggggttctttgggtgggtaatagtcagggggaaaggacagtgtctatactttttaaagatgtatataaatgtttcatgttattggttttgtacctagtcctttgcatggatatataggtacctaatgaaaatcgaggatcagtgtatgacaaatctcccatcctcccctttccttattgcctgtgtcggcaataggaagtagaatagttgtgtgttgtttacttacttgtctgttttagagagatttctatttttggtaggggaatattcttaatatgttttcatatctttatttcattttgtagtcttttgcatgcgctaatgctacggggggaacccctaatgaaagtcgagtttcataatatgacagctcacttcttttcctacnnatatttcccttcactnttagnccaagcntagggcntttagntgntcagcttaattttttgtggttattttatttcattctctaggatctattccattaaggatgcaagtgtgtagatgcatatatatcatttgcttctttcttccgccattattttcctttaacacttagtcccttgcaaggggtctgactatacctaacaaaaataaagacctactaaatccctgccatctggctggaaggtgtagcagtgtattaatgtaactaatagcaacaggtgtgcagcagataagacaggagaagacactcagctatggttgagttgtgaaagctaattagatccagcatttcttatgttgattcagattgaatgaggtagtgaaaagggacctgtgcttttgtaaattctagaaaggcaagaggacaatattgaataaagctgtgtttaaacttcattgctcatatatcttttagtaactggtaaaccggcgaagctgataagccaataagagtgctgtctagaacgcatttgcaaaccgttaagagtagcttctttttgaggcctggacttctgattcatctatagaagtctattatgattccatcaattgcatagcttgtgtacctggtagaaattgtgtcttggaatgaccctttcgagttattgacatggctctgatgaatagaacatgagccccaaaactaaatccaaaaggaattttctatctttcatcccccacatgtggcaagacaagttggccctttcttacccagaggtcttttgtgtgactgcatctttctcctccgttctccattgtgtgctttccattttgtctttagtgcctatactgttaggtgttttcttcactggcattcacaaatttaagccattgctgcctcattagccttgtattttgtgtgcatatcatatatccagacctgtatgttcgctttaagcattcttatatcacactgtctcctcatctaccatatggtaaatgttaaaactccacatttgtctgcatcagggaaaatgcatgggcacacatcctccctccctccctctctgctctcctcccttccttcaggcctcttagcattgtttgttttcccatttctgatactactactccatgctgaagatttgccatattactattttggaaacattgagtgatagaactcctagaaaatttgcaaagaaatgttacatactgtatatcaaactctcagattctagtgttgaaaaagtagcctatactttgctattacttatacctgctgccatagaaaaaaataagtttattcatgacacatttacatttgatcataaataaaagaaaaaagggcacctttttggagttagtcatggtagtcattagtgatatttctgaacagttcttaatttaaaatacttcaaaggaagtaaaggtcatggcttagctgaaggaaatgctccagaaattggactgtgtaaaccatcagtacaataatacgctgtgtatgtatgtgtatataaaatgagaattatggcataattggagcatttgcattaatcaacaaactcacattgagacaaaacttagttttacagctgtcttgattaaagccaagtgttccatgttgctgtgaagaatagcctctttcaaatactttggaaagtagttacttggaaacttgtaaaggtattacatttttatatttaaacacctatagagatcttcaattccttgagtctgagcttgtgggtggaattctaaatttgtatcataatctgtcttttgtgaaacattttgaaaatatgtatatataatattgtatatgcaaattgtgttgtttcacttgtaaagggaaaaggcttatttttctttatatttctgataacttgttttgcatatgaccagcactgactgaaaggcatgtgtagctgcaaacactgttgctttttttgtgaaatgaaaataaaagtatttaaatacaaaca

SEQ ID NO: 13245 - DNA, 512 bp, Homo sapiens
cagtttgttgagatggattttaaaaagagtctatttaaaccaaagtacctggaaccataatctgccatcagattgctaaacattcacataatccccatgtttcatggggcttcagggaaggcaaatacatctgagatgagccacctccaaggacagcatttcctgggctgcaaaactagatgtggattttgttacttaggcctctctaaaaactgaggccatggatatgacatagcttttcttctcacctatgcctttgttacttttgtatttattggaattaaatctctttttaaagagcttccttcccccttcatcccatttgtatttttaaaaactaagttatatatatatttgcttgtttttgcattcttttattttgtgctccattccctgctttgccagttaagtactacctgaaaagtagcggttcaaaagtatggtaaatctcctcccttaaccttattgcctgtgtgggtgacagctaatggaaaagttgatcgatttttttc

SEQ ID NO: 13246 - DNA, 388 bp, Homo sapiens
cccttctccccttcccttattgcctgtcttggcaatggccagtagagtagttatttaagggattttgtttttttgtttttttgttttttttttggtaggggaggtggggaatttctgggtttgtcttttttttaatgtatataaaagtttgctagttgttgttattgttgttctttcactctcaacacagttttttgtttggagttgtaggaatcaaatgtaatgagggacccagacccgagagtgtggtaaatattctttgccttcctcagagcctgtatacacaagcaagtagtatgtgagcactacagggcttgggttttggttttttgcttttgagggttttaatgaggagtgggattgttgagaggaaaaggcaagatatata

SEQ ID NO: 13247 - DNA, 7608 bp, Homo sapiens
ccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgaggtgagggccccaccccaccagggctgcccctcagttccctgcctgtggcaaagacgcggagggccttagctacccacacaacacagggagcacaaaccttgtgtcaggctcctgcccgcctgtcctgtgatcctcccagccacctgccatggggcctgccacttttatccccattttacagatgagggagaagaggcacagagaggtttagtgacctgcccgggtcacacagctgtgtaagtggtggagctgggatccgaagcccggccacctgagccctaagccggagcttttcccgccagttcacgctgctgccccctcactctctggggccttgtggttggcacttggggctcagagcgcaaggtggtcagggcagagagcttgggtcacccagcggtgggagcctctgctgcagagggtgggctcccagacatgctgcttgcccgcagcccctggggactggcttttctgcctggtactgatgggcctcggggtgggggcacctcccacagctacggaagcctggccgcctgcccgacacggcactgcccacgctgcagaatggggcagctgtgactgatctggcctgggacccctttgacccccatcgcctcgctgtgggtaaggaggctgggtgcctgggcttgagggagggtcctgggtcccggataggggctggggagcccagaggtcttgggctcagcaatgatgagcccctgtctgtcctctgcagctggtgaggacgccaggatccgactgtggcgggtacccgcagagggcctggaagaggtgctcaccacgccagagactgtgctcacaggtcaggcaggctcaggaatggggctggggtggccagtgtctcccaagggctcctgatcacccctgccttcctccaggccacacggagaagatctgctccctgcgcttccacccactggcagccaatgtgctggcctcgtcctcctatgacctcactgttcgcatctgggaccttcaggctggagctgatcggctgaagctgcagggccaccaagaccaggtaggacggctgcagaggtggggccagcagtgtggagaggcggggccagcagtgtggagaggtggggccagcagtgaggagtggcggggccagcagtgaggagaggcaggaccagcagcgaggaggggtggggccagcagtgaggagaggggggccagtggtgaggaggggcagggccagcggtgaggaggggccgggctagcattgaggagaaggggggccagcagtgaggagaggggggccagcagtgaggagaggcaagaccagcagtgaggagaggcgggaacagcagtgaggaggggcggcgccagcagtgaggaggggcaggagcagtggggagaggtggggccagcagtgaagcaaggctgtctctcatatcccttcctgcccccagatcttcagcctggcctggagtcctgatgggcagcagctggccactgtctgcaaggatgggcgtgtgcgggtctacaggccccggagtggccctgagcccctgcaggtgagcacacaggggctggggagtggcctcagacctggttcaggggtgctggctgggtgtcacgcgatgtatctcaacaggaaggcccagggcccaagggaggacgcggagctcgcattgtctgggtatgtgatggtcgctgtctgctggtgtctggctttgacaggtgaggactcaggcatccccatccccaggcttcagaagccacctgtgtcccccttctccacagtcacatacatttgtcaggctttcagaaaccattcctgcccctcactggatggttgggtgggtgggtagatgattggatgagtgggtagatgggtggatggataggtgggtgaatggatggatgggtggatgaatgaatgtggggatagatgggcggatggctggatggatgaatgagggggtagggagagatcgatggatgagttgggggtaagggggagatggatgcaggggagggtgaggggggtaggggagatggagggatgttttgggggtagtggggagatggatagaggggtgggtgaggggttggggggagatagatgcaggggtgcacaaggggctctgggggagatggaagcaggggcggtgaggcagtcaggggtagatggatgggtgagtgattagtggaggagaaagagtcaatggggaacccagaggtggaggggcaggttaggatgtggctgcggtgccgggccacactaggcctcgcctacaacccagaacagagcaggggctacgtgggcgccttctccctgccccaggccccttcagctctgaaacacctgcttcagcccccaaacccccttgcagccaaagtgagcgccagctgctcctatatgaagctgaggccctggccggcggacccttggcagtgttgggcctggacgtggctccctcaaccctgctgcccagctacgacccagacactggcctggtgctcctgaccggcaaggtgggctgggctggagggcgggatggcaggtgagaggtggtggggggaaggccagtgttgccggagggttcccagcctgccttcttccccgcagggcgacacccgtgtattcctgtacgagctgctccccgagtcccctttcttcctggagtgcaacagcttcacgtcgcctgacccccacaaggtgaggccaccctggcgcctcgtccccgatgggaccacaaggctgccctgccccctggtggccatgtgggcaagtacaggagcctgtgggtcgggggtcagagtcctgggctggggctgggcctggggctgtgcccagtgactggcaagaagagttgctgctggaattatttaggaattttgagagccattgtcatactcaaccattattaaaaatcatactgtaggccgggtacggtggcctggaatcccaacacttcggaaggctgaggcaggagaattgcttgagcccaggagttcaagaccagcctgggcaacatagcaagaccccatctctacaaaacaaacaaaaaattgcactagataaggttaaactatatgaacctacaatatgaacctaaaaataatattaaaaaccaaagtaataaacactcagtttatcacttctaattaatttatccaattttactattatttgtgctgaggtcacatgtttctgtgttggagtgcatggaggaaatgcaggatgatgtgctatttacatctcttcccaacaccacattcagggagtggaggtggcacgtagaagctgcccatggtgggagtttgtaaactgtggaaataggaaaacaccacaaatcagggctttccctccagagagcaggttgttcaacatgatcaacacgttactgtccagggacaggccctaggcatggtggtcctaagtgaggggtgccggcaccctggggagactacgtgcccagccatgagctctaggtcccagcggcagctccgactcccttgctcccccagggcctcgtcctcctgcctaagacggagtgcgacgtgcgggaagtggagctgatgcggtgcctgcggctgcgtcagtcctccctggagcctgtggccttccggctgccccgagtccgggtgagggtggggacctgggactcccatgcccaccgccttctcggtgcctagaggggagtttgggtcccgtctgacccagcttccaaacttccctacccattgttcatggggacacctacccccttctgctgagatgctgaaactcatggaagccccaggctggtgggagggtcccaggtcttgccctgtccctccccaacagatgcccgtgtgccctgggcacctggtcaatgtctcaggacagcccgtttctccctctgcagaaagagttcttccaggatgacgtgttcccagacacggctgtgatctgggagcctgtgctcagtgccgaggcctggctgcaaggcgctaatgggcagccctggcttctcagcctgcagcctcctgacatgagcccaggtgcaccgagggactgggtgtggggaggaagcgggatgggggttggagaaagggacagaaggcccaggttgaagttccattcctgttggcacgcagaatcctctggcctttgggagggtggagtggctgtgtcaatcagtctctgagccagtggagggcagggctcgtggtctgtgttttcatcacaggtccccacccctaacacacacacacacgcacacactgtggtgtctagggcagggcttatacagtgaggctccattgactgttaataccacctcttagatctgcgccatagaaatcccctaggtcggccaggcgcggtggctcatgcctgtaatcccagcactttaggaggctgaggcgagtggatcacctgaggtcgggggtttgagaccagcctggccaacatggtgaaaccccatctctactaaaaatacaaaattagcctggcgtggtgggcgcctgcaatcccaactactccagaggctgaagcaggagaatcgcttgaacccagaggaggcggaggttgcagtcagcctaggtcacatcattgcactccagcctgggcaacaagagcaaaactccatctcaaaaaaaaaaaaaaaaaagaaagaaagaaaagaaagaaagaaatccccgagggcttggcaccaaagagccctaacgaaggggactctctgacacgtgtccttgctctgtcccagtgagccaagccccccgagaggcccctgctcgtcgggccccatcctcagcgcagtacctggaagaaaagtctgaccagcaaaagaaggaggaggtaggcatgggagagagcagctgtgcggaggtgacagagtcctggctgcacctggccacggccccttagttctccatccccaacccagactgggacagcagccacatgtcacgtccccttcacaccagagcctggtggggagaccttccagagccctaccactgaccatggggcccgggaagtgggggagggcagtgggagccctgccctggccaggccaaacccagcctaagccggcagttctgggcccaagtgcttttgggaccttggagtatattttgagcacttgaggccatgtgcagagatagtagcccttgtatctggtgccacatgccgcagcctctcagtctcttactccccctgtctcttctttgtgtctttttcaatagaaacccatcgattttgtcagggctgtaattaaaatggctcttttgaggccgggcacggtggttcatgtctgtaatcctaacactttgggagcccaaggcaggcggattgcttgagctcaggagtttgagaccaccctgggcaacacggtgaaaccccgtctgtactaaaatacaaaaatttagccgggcatggtggcgggcgcctgtgatcccagctactcgggagactgaggcaggagaatcacttgaacccaggaggtggagattgcagtgagccgaaatcgtgccactgtactccagcctgggtgacagagcgagactccgtctcaataaataaataaataaataaaaataaaaataaaaataaaatatagtggctcttttggccaggcatggtggttcacacctgtaatcccagcactttgggagaccaaagcaagaggatataagtgatggagtttgagacccagcctgagaccagtgaaaccccatctctacaaaaaaattttttaaattaaccaggtgtggccaggcatggtggctcacgcctgtaatcccagcactttgggaggccgaggagggcggatcacctgaggttgggagttcgacaccagcctgaccaacatgatgaaacctcgtctctactaaaaacacaaaattagccgggcatggtggcgcatacctgtaatcccagctacttgggaggctgaggcaggagaatcgcttgaacccaggaggcagaggttgtggtgagccgagattgtgccattgcactccagcctaggcaacaagaacaaaactctgtctcaaaaaaataaataaataaaataaaaattaaccaggtgtggtgttacacacttgtagtcccagctacttgggaggctgaggcaggagaattgcttgcacccagaaagtcaaggctgcagtgagccatgattgcaccactgcactccagccttggtgacagagcaagaccttgtctctctctaaaacaaacaaacaaacaaaaaggccgggcgctgtggctcacgcctgtaatcccagcaccgtgggaggccgaggcgggcggatcacgaggtcaggagatcgagaccatcctggctaacacggtgaaacccccgtctctactaaaaatacaaaaaattagccgggcatggtggtgggcgcctgtagtcccagctccttgggaggctgaggcaggacagtggtgtaaacccgggaggcagagcttgcagtgagccgagatcgcgccactgcactccatccagcctgggcgacagagcaagactccgtctaaaaaaaaaaaaaagttcttttcacagccttgtcagggttgttcttggagtgggagagggaacagggagtcctattcccttacctacccttcttctgccctctctcccagctgctgaatgccatggtggcaaaactggggaaccgggaggacccactcccccaggactcctttgaaggcgtggacgaggacgagtgggtgagtagtgagtggcctcacttcccggcaggcagcgcggtccctcgcacatgccacggtgcatgcctcctcccttcccaggccctcctgactccctcccacctcttggtgtttcgccccaggactagcctgcgcccccgtcacctccacctcacctgtgctgccacttcctagtgcacacctcacggctcatcctcaagctggaagatacctctctggccccggcacatgtcacccctgcactcctgccttcccgtgggcacttccacatcctctgggcctctggcagttcccagggactgttttcacctctgctgtctctggggtcagctgctgctcatcagctgcccgctagcatgtggccaggggtgcagggtggcggggggtcagcagcatgtccctgggcaggccctgggcaccctgtctcccctggtctcactgctgacctgggctggtcccagcctggattggcctcatccaggatctttggtcaccccacgctgccccatcttgcctgctgttccagttctggtcaagggccttgggggctggccccccaccaggccttctagagcagcaccagtctcagggccctgggaccagctgccctacttcccaggtttgtagccaggagaagggggcatcacagagctgatggtccaataaggggggtgtgagccccgcagggactggcccgcacctgccttggatgttttcagcaattaaacttttttaagctggcca

SEQ ID NO: 13248 - DNA, 7610 bp, Homo sapiens
ccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgaggtgagggccccaccccaccagggctgcccctcagttccctgcctgtggcaaagacgcggagggccttagctacccacacaacacagggagcacaaaccttgtgtcaggctcctgcccgcctgtcctgtgatcctcccagccacctgccatggggcctgccacttttatccccattttacagatgagggagaagaggcacagagaggtttagtgacctgcccgggtcacacagctgtgtaagtggtggagctgggatccgaagcccggccacctgagccctaagccggagcttttcccgccagttcacgctgctgccccctcactctctggggccttgtggttggcacttggggctcagagcgcaaggtggtcagggcagagagcttgggtcacccagcggtgggagcctctgctgcagagggtgggctcccagacatgctgcttgcccgcagcccctggggactggcttttctgcctggtactgatgggcctcggggtgggggcacctcccacagctacggaagcctggccgcctgcccgacacggcactgcccacgctgcagaatggggcagctgtgactgatctggcctgggacccctttgacccccatcgcctcgctgtgggtaaggaggctgggtgcctgggcttgagggagggtcctgggtcccggataggggctggggagcccagaggtcttgggctcagcaatgatgagcccctgtctgtcctctgcagctggtgaggacgccaggatccgactgtggcgggtacccgcagagggcctggaagaggtgctcaccacgccagagactgtgctcacaggtcaggcaggctcaggaatggggctggggtggccagtgtctcccaagggctcctgatcacccctgccttcctccaggccacacggagaagatctgctccctgcgcttccacccactggcagccaatgtgctggcctcgtcctcctatgacctcactgttcgcatctgggaccttcaggctggagctgatcggctgaagctgcagggccaccaagaccaggtaggacggctgcagaggtggggccagcagtgtggagaggcggggccagcagtgtggagaggtggggccagcagtgaggagtggcggggccagcagtgaggagaggcaggaccagcagcgaggaggggtggggccagcagtgaggagaggggggccagtggtgaggaggggcagggccagcggtgaggaggggccgggctagcattgaggagaaggggggccagcagtgaggagaggggggccagcagtgaggagaggcaagaccagcagtgaggagaggcgggaacagcagtgaggaggggcggcgccagcagtgaggaggggcaggagcagtggggagaggtggggccagcagtgaagcaaggctgtctctcatatcccttcctgcccccagatcttcagcctggcctggagtcctgatgggcagcagctggccactgtctgcaaggatgggcgtgtgcgggtctacaggccccggagtggccctgagcccctgcaggtgagcacacaggggctggggagtggcctcagacctggttcaggggtgctggctgggtgtcacgcgatgtatctcaacaggaaggcccagggcccaagggaggacgcggagctcgcattgtctgggtatgtgatggtcgctgtctgctggtgtctggctttgacaggtgaggactcaggcatccccatccccaggcttcagaagccacctgtgtcccccttctccacagtcacatacatttgtcaggctttcagaaaccattcctgcccctcactggatggttgggtgggtgggtagatgattggatgagtgggtagatgggtggatggataggtgggtgaatggatggatgggtggatgaatgaatgtggggatagatgggcggatggctggatggatgaatgagggggtagggagagatcgatggatgagttgggggtaagggggagatggatgcaggggagggtgaggggggtaggggagatggagggatgttttgggggtagtggggagatggatagaggggtgggtgaggggttggggggagatagatgcaggggtgcacaaggggctctgggggagatggaagcaggggcggtgaggcagtcaggggtagatggatgggtgagtgattagtggaggagaaagagtcaatggggaacccagaggtggaggggcaggttaggatgtggctgcggtgccgggccacactaggcctcgcctacaacccagaacagagcaggggctacgtgggcgccttctccctgccccaggccccttcagctctgaaacacctgcttcagcccccaaacccccttgcagccaaagtgagcgccagctgctcctatatgaagctgaggccctggccggcggacccttggcagtgttgggcctggacgtggctccctcaaccctgctgcccagctacgacccagacactggcctggtgctcctgaccggcaaggtgggctgggctggagggcgggatggcaggtgagaggtggtggggggaaggccagtgttgccggagggttcccagcctgccttcttccccgcagggcgacacccgtgtattcctgtacgagctgctccccgagtcccctttcttcctggagtgcaacagcttcacgtcgcctgacccccacaaggtgaggccaccctggcgcctcgtccccgatgggaccacaaggctgccctgccccctggtggccatgtgggcaagtacaggagcctgtgggtcgggggtcagagtcctgggctggggctgggcctggggctgtgcccagtgactggcaagaagagttgctgctggaattatttaggaattttgagagccattgtcatactcaaccattattaaaaatcatactgtaggccgggtacggtggcctggaatcccaacacttcggaaggctgaggcaggagaattgcttgagcccaggagttcaagaccagcctgggcaacatagcaagaccccatctctacaaaacaaacaaaaaattgcactagataaggttaaactatatgaacctacaatatgaacctaaaaataatattaaaaaccaaagtaataaacactcagtttatcacttctaattaatttatccaattttactattatttgtgctgaggtcacatgtttctgtgttggagtgcatggaggaaatgcaggatgatgtgctatttacatctcttcccaacaccacattcagggagtggaggtggcacgtagaagctgcccatggtgggagtttgtaaactgtggaaataggaaaacaccacaaatcagggctttccctccagagagcaggttgttcaacatgatcaacacgttactgtccagggacaggccctaggcatggtggtcctaagtgaggggtgccggcaccctggggagactacgtgcccagccatgagctctaggtcccagcggcagctccgactcccttgctcccccagggcctcgtcctcctgcctaagacggagtgcgacgtgcgggaagtggagctgatgcggtgcctgcggctgcgtcagtcctccctggagcctgtggccttccggctgccccgagtccgggtgagggtggggacctgggactcccatgcccaccgccttctcggtgcctagaggggagtttgggtcccgtctgacccagcttccaaacttccctacccattgttcatggggacacctacccccttctgctgagatgctgaaactcatggaagccccaggctggtgggagggtcccaggtcttgccctgtccctccccaacagatgcccgtgtgccctgggcacctggtcaatgtctcaggacagcccgtttctccctctgcagaaagagttcttccaggatgacgtgttcccagacacggctgtgatctgggagcctgtgctcagtgccgaggcctggctgcaaggcgctaatgggcagccctggcttctcagcctgcagcctcctgacatgagcccaggtgcaccgagggactgggtgtggggaggaagcgggatgggggttggagaaagggacagaaggcccaggttgaagttccattcctgttggcacgcagaatcctctggcctttgggagggtggagtggctgtgtcaatcagtctctgagccagtggagggcagggctcgtggtctgtgttttcatcacaggtccccacccctaacacacacacacacgcacacactgtggtgtctagggcagggcttatacagtgaggctccattgactgttaataccacctcttagatctgcgccatagaaatcccctaggtcggccaggcgcggtggctcatgcctgtaatcccagcactttaggaggctgaggcgagtggatcacctgaggtcgggggtttgagaccagcctggccaacatggtgaaaccccatctctactaaaaatacaaaattagcctggcgtggtgggcgcctgcaatcccaactactccagaggctgaagcaggagaatcgcttgaacccagaggaggcggaggttgcagtcagcctaggtcacatcattgcactccagcctgggcaacaagagcaaaactccatctcaaaaaaaaaaaaaaaaaaagaaagaaagaaaagaaagaaagaaatccccgagggcttggcaccaaagagccctaacgaaggggactctctgacacgtgtccttgctctgtcccagtgagccaagccccccgagaggcccctgctcgtcgggccccatcctcagcgcagtacctggaagaaaagtctgaccagcaaaagaaggaggaggtaggcatgggagagagcagctgtgcggaggtgacagagtcctggctgcacctggccacggccccttagttctccatccccaacccagactgggacagcagccacatgtcacgtccccttcacaccagagcctggtggggagaccttccagagccctaccactgaccatggggcccgggaagtgggggagggcagtgggagccctgccctggccaggccaaacccagcctaagccggcagttctgggcccaagtgcttttgggaccttggagtatattttgagcacttgaggccatgtgcagagatagtagcccttgtatctggtgccacatgccgcagcctctcagtctcttactccccctgtctcttctttgtgtctttttcaatagaaacccatcgattttgtcagggctgtaattaaaatggctcttttgaggccgggcacggtggttcatgtctgtaatcctaacactttgggagcccaaggcaggcggattgcttgagctcaggagtttgagaccaccctgggcaacacggtgaaaccccgtctgtactaaaatacaaaaatttagccgggcatggtggcgggcgcctgtgatcccagctactcgggagactgaggcaggagaatcacttgaacccaggaggtggagattgcagtgagccgaaatcgtgccactgtactccagcctgggtgacagagcgagactccgtctcaataaataaataaataaataaaaataaaaataaaaataaaatatagtggctcttttggccaggcatggtggttcacacctgtaatcccagcactttgggagaccaaagcaagaggatataagtgatggagtttgagacccagcctgagaccagtgaaaccccatctctacaaaaaaattttttaaattaaccaggtgtggccaggcatggtggctcacgcctgtaatcccagcactttgggaggccgaggagggcggatcacctgaggttgggagttcgacaccagcctgaccaacatgatgaaacctcgtctctactaaaaacacaaaattagccgggcatggtggcgcatacctgtaatcccagctacttgggaggctgaggcaggagaatcgcttgaacccaggaggcagaggttgtggtgagccgagattgtgccattgcactccagcctaggcaacaagaacaaaactctgtctcaaaaaaataaataaataaaataaaaattaaccaggtgtggtgttacacacttgtagtcccagctacttgggaggctgaggcaggagaattgcttgcacccagaaagtcaaggctgcagtgagccatgattgcaccactgcactccagccttggtgacagagcaagaccttgtctctctctaaaacaaacaaacaaacaaaaaggccgggcgctgtggctcacgcctgtaatcccagcaccgtgggaggccgaggcgggcggatcacgaggtcaggagatcgagaccatcctggctaacacggtgaaacccccgtctctactaaaaatacaaaaaattagccgggcatggtggtgggcgcctgtaatcccagctccttgggaggctgaggcaggacagtggtgtaaacccgggaggcagagcttgcagtgagccgagatcgcgccactgcactccatccagcctgggcgacagagcaagactccgtctaaaaaaaaaaaaaaagttcttttcacagccttgtcagggttgttcttggagtgggagagggaacagggagtcctattcccttacctacccttcttctgccctctctcccagctgctgaatgccatggtggcaaaactggggaaccgggaggacccactcccccaggactcctttgaaggcgtggacgaggacgagtgggtgagtagtgagtggcctcacttcccggcaggcagcgcggtccctcgcacatgccacggtgcatgcctcctcccttcccaggccctcctgactccctcccacctcttggtgtttcgccccaggactagcctgcgcccccgtcacctccacctcacctgtgctgccacttcctagtgcacacctcacggctcatcctcaagctggaagatacctctctggccccggcacatgtcacccctgcactcctgccttcccgtgggcacttccacatcctctgggcctctggcagttcccagggactgttttcacctctgctgtctctggggtcagctgctgctcatcagctgcccgctagcatgtggccaggggtgcagggtggcggggggtcagcagcatgtccctgggcaggccctgggcaccctgtctcccctggtctcactgctgacctgggctggtcccagcctggattggcctcatccaggatctttggtcaccccacgctgccccatcttgcctgctgttccagttctggtcaagggccttgggggctggccccccaccaggccttctagagcagcaccagtctcagggccctgggaccagctgccctacttcccaggtttgtagccaggagaagggggcatcacagagctgatggtccaataaggggggtgtgagccccgcagggactggcccgcacctgccttggatgttttcagcaattaaacttttttaagctggcca

SEQ ID NO: 13249 - DNA, 102 bp, Homo sapiens
cccgccaccatgcctggctaatttttgtatttttagtagacatggggtttcaccatgttggtcaggctggtctcgaactcctgacctcaggtgatccacccg

SEQ ID NO: 13250 - DNA, 678 bp, Homo sapiens
aactttcatcccaccatttgccgaatgctgtgcgccagatgctcttccaggcgcttgacatctaacagcagagaagagagaggaaatgcttgcccaacaggaactcccattctagtggaaggaaacagattctcaacaataaacataaaaataaagggaggccaaggtgggaggattgcttgaacccaggagtttgaggtcagactgggcaacataggggaacccttgtctctacaaagaatacaaacattagctgggcgcggtggctcacgcctgtaatccgagcacttcgggaggccaaggcaggcggatcacgaggtcaggagcacgagaccatcctggctaacacggtgaaaccccgtctttactaaaaatacaaaaaattagccggacatggtggcccatgcctgtagtcccagctactcaggaggctgaggcaagagaatctcttgaacccaggaagcagaggttgcagtgagccgaggtcatgccactgcactccaggctgggcaacagggagacgctctcaaaaagacaaaaaacaaacattaaccacatgtgttggcacatgcctgtggtcccagctactcagaaagctgaggtgaaagtatcactcaaggctggaaggtcaagactgcagtgagccatgatcatgctactgtactgcagcctgggcaa

SEQ ID NO: 13251 - DNA, 678 bp, Homo sapiens
aactttcatcccaccatttgccgaatgctgtgcgccagatgctcttccaggcgcttgacatctaacagcagagaagagagaggaaatgcttgcccaaaaggaactcccattctagtggaaggaaacagattctcaacaataaacataaaaataaagggaggccaaggtgggaggattgcttgaacccaggagtttgaggtcagactgggcaacataggggaacccttgtctctacaaagaatacaaacattagctgggcgcggtggctcacgcctgtaatccgagcacttcgggaggccaaggcaggcggatcacgaggtcaggagcacgagaccatcctggctaacacggtgaaaccccgtctttactaaaaatacaaaaaattagccggacatggtggcccatgcctgtagtcccagctactcaggaggctgaggcaagagaatctcttgaacccaggaagcagaggttgcagtgagccgaggtcatgccactgcactccaggctgggcaacagggagacgctctcaaaaagacaaaaaacaaacattaaccacatgtgttggcacatgcctgtggtcccagctactcagaaagctgaggtgaaagtatcactcaaggctggaaggtcaagactgcagtgagccatgatcatgctactgtactgcagcctgggcaa

SEQ ID NO: 13252 - DNA, 102 bp, Homo sapiens; identical to SEQ ID NO: 13249

SEQ ID NO: 13253 - DNA, 14525 bp, Homo sapiens
tacagttctgctcacggccatgatttattacagtgaaaggatacaaaacaaaatcagcaaaggaaaaaagacacatggggtgaagtcaggggaaactaagtgcaagcttccaagaatcctccgccagtggaatcacagaggatgagcttaattctcccagcaaccagttgtaacagcacttgtgaaacactgtcaaccagaaaagcttgttagagactgagtgcctggggtttttactgggagctggtcacaaaggtagtctctggctggcacataccaaaattccagactcccagaaggaaagcaggtgttcaggagaaactatattgttttacagtttagatatagtaagctactttgatcagttctgggaatggtggaagccccctgaactccaagttcccagatgccaatcaagggccaaccttgtaaagcaagtctctaaagttaagtagtcaagtcggcttcattaacacttttttcggcacagcaattttatctcaacattttttcttcaaggcccataaatactcagtttcatgaattgtactgtgaaccaggtttactatctgctggtttcctcattaatgagtcgaataagtcttcgacacatgctcatcttatacacatgtatatatatgagtcatgttgtcaacttaaaaggtttgacagataataacctaatcaagctaaataaagtccagccaaaattaattaataaaaaacattaactaaataatatcaaggctcaatctacacctcactttagttatttaggaaagaaaaaaaataacctttatactagcatttcacactttcttactgactttagaacgtcttctgatttaggtggcaatcacttgcctagttgtacttagggcaatattaataaaataatgaatgtttctgcaagaaataatatataaagattaatttcctctttaattttaccaatcagaatattaaaaatactacatcattgttttagatgaaattccccatttaaatatattatacataagccaaattttagaaatagctccttgtatcactgtacaattttgggcctttaaaaaaaaagctcaattttaagtttgaatataatgtgcagtttatataacatatatattatattatatatactttatacattatataaagtattatccttattgtgaactttattatgcttctgaaatttctccatcatttcaaatttacttcaataaaaatttccctatattttgtgaattgcattttcaaatcagaagtaatgttacaaatttctgtctataataaaaaacaaaatattcacgctttattaataatcctaattagaaaaggatgcaattaagagctggcatagctaacataagcataagaaaggtaaacttttcttgaattaaaaaaaggaaatactttaatgaaaaaaaatcaaggacagaaggaaggagaaaattttctaaacagcagctggtccttcttcacaatttgcattacttatgcaaatacatcattaaataatactcatcttatatttacaaaatagaggaaagggaaaaacctaaagtatcaggatctttcatttcttatccctcttccaatcttctggatacattagtttacataccaactaaacatgtgatactagttaactatagttgagagcttatcaattaagtcatcaatagtgtaaacaagaagttgaatgtctgctttttccctcattcggtgatcactgtgttttcggaggatgacatccacatctgtgctgagtactcgatcggcaacctgcattgatgtatgccaaggtacaatgtcatccttcatgccatggagcaatcttatggggcagttcacaggaattgggctatgtaacaagcagtgatgttcagcttctttaatgaaactgtactgaacgttataaactccttcttcagagtattttgatggcatgctccacacacctttcatctctacttccttttttagctattggaaaaagaaagaaaaataaaagtatttgtgactttaggcaacattaacacatgcaatagttttaagtaatctaatgaaagcagttcttgaataagaggatagagataacaaaagtataacaataataattatcaataattactacatgcaaggtactgtgatgggtattttatacatattattccataagattctgataataattctgttattattctatttttataaaagaggatattatggtttagataaatgaaatactgtgtgcaacagttcagggctaggctactaactgttatggctaagactcaaacttaaatttaaatttatttaattttatcatacactatctcaaatcagatgttgcttcaccccaactgaaaagaaaaatgaagagggagaaaagcactacaatttcttggaatcagtccaggtatcattcatatttaaataaaatcaaatcttagaataaacattgtttagatttcaaaattgtaaacctaaaagtgcttataagtagctaaaatggatatggcatagggaaagaagagaaagaatcaaacacagaactaagaataaaaaaataagagtaattacattgtaacaatcatacacatactcatgcaattttaggctgaatgtaaagaaatatagtttttccttccagagtcctataaaagagaaaaaatttgatttttgttctggatgacaaagaagtcttccacatacttcctgaaagccaaacaataatatctgtatatttattcccttaaaatgaaatatacatgtcctttgactttttgagaactcttattttttatataatttatcttaatttttctaaaaaaattagaattttgtataatgagtaacatgcagtcattatagaaaacataaaaataattaaagaaataaatcacccataatcctatcttatggagagaaaaaccattaatatatggcttatttccttccaatatttgtctatatgtgttttggtttttgtgtaatatgtaaaatacatacatattacacattcatatacagttttctatgctgtttatttagtacatatatttctgggtttaaaaaattctatgaaaaggttttaaatgctgcacagcagtccaccataattgacttaattagtttgaccatctcatactgtggtattgtcatgaacacttttgagcataaaagtttatttatatataatagattattggaaagatgatcacagcttaaaactaaaacaaaaatcaagctatgaatagtttcaagactgttacaatcatataatattaagggcatttctagaaaaatggaatggacatcttatcaaaaattttaaaaaataaggaaagaaaagctacacatatttgaaaaatttaaagtttcaacaaatatactatgattttcccatgtttaaaattgttaatttattgcaaatgtaaaaaggaaaacaagaacttaaaaaatatgtatgacataatataatctatatgtacttaggctttaatgtatttttaattccaaaaagacttaataattcagtaaaaaaaaaactgtacttctaaatatgtctccaaatgatttaaaattaatgaaattctacaaaactataaaatgtatataaatctatatcaatatcatggcattctctgtattaaaacaacatatgaaccaaatatttaaagtaaagatgacatttagctatcctcaagctactcaggattgtttctgaatttgtaaatacttcagcagatagaacttagtcccactggttattagctgaagtggaggctttgctaattaaggcgacactgaattaataatagtttcattttaagcatccctggcccccaactagctctgctacctgccactgaattgaatgaaaatggtccatctgaagaacaaagttaactttataaaatgttgtatgtctcaagtcctcaagaacaaaaagttcagaaacagcaaagacattacccaaagaaaatgtacaatatattaagttctacatcaacaaaacttatcaaggcaatgtggttcagaagcttacattcccaacagctgtgcatcatgtctgaggccctctagtgtccaaagaaggtgataatgattagagtcagttaaagaggatggtcaagttcttagagaagaaatgagaaatgctgggcttactattcccagggttataaaagatagtaaaaatctccacatctgctccgttgacattgttagggctagctgtttatgtggagaagagatagcggtcttagtgttggtgctctttccttatacatgcttttaagttaaccaagggctcaacatgcttctgttaacaactgcttatctgagtaagtattagcaaaaaatgccttgatttgcagattataaatcttctcaattagaaagtatctaccctatgctcactctgactgatgtgaacacacacacacgcagagaaatgtacatggccaggcacagtggcttgtgtctctaatctcagcactttgggggtccaaggcaggagaatctcttgagcctaggagttcaagaccggcctgggcaacatggcgagaccccatcgctacaaaaaatacaaaaatcagccaggcatagtggtgtgcacttgtggtcccagctactcaggaggctgaggtgggaggatctcttgagtctgaggggtcaaggctgcagtaagcaatgactgcaccactgcactccagcctgggcaacagagataccctaaaaacccccccaaataaaaacaaaaccaaaacaaatgtacacaggttttgtcatttaccaataattacaaaatacaataaacccccaacccccaaaaatcaactccttttcaatctgctatgtctttgagataatttcctacccaagaagcgctgtattattgagttaagaggatggagcaaggagtccacatttagatccacaaaatgtcaaaggtgggaaaaacatgaagacattgagcaactatgtatgagaaaccaccaagaaagtgaacaaaattcagaaacaggagataagttcaaggaagaccagctttgtaatttcagctctgataggaaataatatgagaaacctgaatacacacacaatgctatttcttaaggagcttaaaacaacgtgaactaagaatgaacttagttaatatatggcacaggtattaatgcagaacttgaggcaaatcaatgacattctactattcaacactgcatacgttttttcttctttttttttaaatttctgaacctccttctcctcttcccccattctctaaagcattgttctcaaactttacaagaggtttgttaaaacacagactgctgggccatacccccagtttctgattcagggtaaaacccaagaatttgggtttctaacaagttctcaggtgctgctgctgctgctagcctagggaccatattttttaactactgctctgttttctttaatttctgtgtctctgtcactctgactgacaatatctgtctggagagttctgttgggaggaactgaggctgcttttaggctaaaacaaagacagtcagctctccatattcatggtttctgcatccatggattcaactaactttgtatcaaaaatatctggaaaaaaaaggttacctctgtattgaacgtgtacagtctttttttcttgtccgtattccctaaacgatacagtatagcaacaatttacatagcgcttacattgtactaggtattttaagtaatctggcaatgatttagattatacaagattatgtgcaaatactacaccattttttttctcagagacttgaccatctgtggattttggtatccatgggaggtcttggaagcaatccccttcagataccaagggatgactgcagtttcagttcattagcccactctaacatagtcataagaacaggcactactccccatatgccacaaagtaagaggaccaaaaggagatcacgatgtatgattcaaataagtaaatgtaataataaagaaaatgtggctaaaaaaaaagaaacttcaaagtgtgatattgttaatgtgtctcaaatatttggcagaatgatttgaagagactatgaagaaacgaaatcttaaacaagatgacaaatagttaaagatagaaaagaggttgtgtacagaaaggcagctaagacaaaagttgggccagcacagtaagtcaaaggaattattgttttctgtccccccttccctcaaagaaagagggagcagaagaagtataagcggtaaatatattgaggtggcaaaagtgacttttgacttacctcaacaggaagctgattaaactttgtcactaaggtatctgcaggctgtagctacaccaataagagccacgaccttctctggtcgtgcaattgcagcatgaagcataagccaccctccaaggctagatccaacaagaatctaaaaataaaataaaataaaacattaggtctttaagatagaacaggttataaacataaaacaaaatatgtacaataaaaaattagaaagtaaaaatagaatcattttaaatcaaatatcaaaatggattaaacatttaaattaaataaaaacattttcatatctaaagaaacagcttaggccgggtgtggtggctcacgcctgtaatcccagcactttgggaggcccaggcgggcggatcacgaggtcaggagatcgagaccatcctggccaacacggtgaaaccccatctctactaaaaatacgaacaattagccgggcgtggtggcgggtgcctgtagtcccagctacctgggaggctgaggcaggaggatgccgtgaacccgggaggcagagcttgcagtgagccaagattgcgccactgcactccaggctgggtgacagcacgagactccatctcaaaaaacaaaacaaaacaaaacaaacagcttaaatacgaggttacagtaattatcatcatacttaacaaaacagtcacctgtggcccatcagctaagtcatcaattatagaaagaacatcttttctccatttccccagtgtgctttcctctgagttaccatctgaacttccaactcctgagtaatcaaacctggaaaaaggggaaaaaaatctatatctaaatatctatatatctgcttctttaatttttaagaaagatagcaccttcctcattactataatgcttatagtgaaacatcacaatcaatatgtattttagcaaattctattggcttattaactttcaaatacctcctgtgtccaatcactttctcacctcctccactgctaccagcctgttgctagtcacactgtctctcaacctaactgaatgcaatagtctcctaaaaagtctcctgtttgcattttcacactcattgtctttccctatatagtagagtgatccttttaaaacaaaaccatgtcttgcaaaccctccaaaggctttctataatctttaaatccagagcccttaccatactttggtgcctgatcacctctctgatctcatttctcattgttttctctctctccctccctccctcccaactgtatcttcgctttgcttcttgaagctcccatctcatcagcttttctctccacatggcatactctcctccagatagccatttagattgctcccacacttcattcaggcagttggctcaaatattacatcctcagaaaagcctcccatgaccattcaattattaaaactgtgctgctttcatcattctctaattctttactctgcttcattttcttcatagcacttattactacttgagatatatttgattatttatggtccatctcccacattagaatgaaagttccacatgggcacaagctttgtttcaatgcgttcctagtgcctagttcagttccttgcgagtggtaggtgcttagtgtatatttagtgaattgatggaagggaaggagaccagaataaaattcatcatcaccaacccatccctttctccttccaacttcctagttatctaggctcagttatctgtctgatctatgaattttacctctccttaagggtatcaaatcaataaaaaatcatggtggtataaagtatcataccacacccacaggttacctaaactctagtcatactgaactactcctaattcccagttacacccttttataacttagagccttagcatgctgttctgctgccaagaacagcttcctccccaacccaaattcgtagtcaccctttaagtcatgtcacctcctctgaggaacttcacttgacatatatgccccatttagtaccagtcactttcttttgtatgtactcaacacttttcatattgtattgtaatcaagtttgtttttaaacattcatctccctctgactagaatgtcagttccttaagaggaggctgttttattcgtttgtttttccaggccacagaatactgcctgccctataccatcaccattctttctcatttcttcttatgttcatccctttcttggtactttggtaagtccagtatcttggtgtaggtgtttatttgtcatcttagacctagactatcacagtagccttctatcttgtgtctctatgactctgtctttaaatagagtcactatatacatgtcagtttttttctttaacattttagcattaccttcagtgctccctgtgatatacaacataaacacttagtgctttggcctgtttttttgaaccattatattctggtcatttcagattgatttcacaataaattttacagtaaatttttttttactactaaattttacagtagtactcacttcatcagggaatactactgctttagacaaattgatgaacttactgttcctaaaataggtctatgttttcttatgtgtttcacatctcacactgttgattcctttacctggaataccttcttccatcatcttctttactgatatattttcccttctttactgatatcctttcccagagcctagttcaaatgaacctttttggtggaatggctggtacagtaagtaagggatttatgagaaataggggagagaagaaattaaatttttctttaggtttgaagtgaaacgattttggatccttgggaaatagaacagggcaactggtgcagtctaaatcagttactgtttccccctcaatccagggtatgtaagagatgggtagaaggggtggaagaaaaaagggggaaagacaccaactaattttctccttttctctcttcataggtggcaattggatatggctgaatgtggcatcttttacagttagctgccttccaaatatatggtgaggatgcaaaatacttgtacagctccttcatgaaggaaaatataaatacttggtgatactaacagggtaccattaaaaaaatatagttaactctcactgaaccccaatccagagacaaagataatccaaacatattcagcactttaaaacttttaaacagtagcacatctccatcttagcagcctcaatagtctgggatgtagtcccaaataaaaattctattacaaataattatgagagaataccagccttaaaaccatatgttatattcctgagatctgaatcagtcttattttaggcatggtgataggaccttaataaaacattttcatatagtcatatgttttatttcttgtgtaataaactatttcatcattgaagatctaaattttacagcaaaaaatcccaacaaaagcaacctgaaaaattagagaatagaagataaaatctcttataataaagtgcaatcaatagttaacaataattagactgtgatgaactttgataagagcaaataaaatggaacttgttcaaactaaatatttgtagttaagcactattctttatgaaggtatactcacacaggatccaaaaatgcagaaaagccacattatgtcttatagggagacaggaactggttataactctcatagtctcaaagctgaaattttagaactggtaaaatggtgatttctcgattcaaatttattcagtggcaaaaaagaaaagtgataacaatatttttgatattatgatcttctgctcaggacagtccccctccttggacagcacttccctcccacccaaatctgaattattcttcaacgttcctttatctatttcaatcccactgtctctaactttatgcaattaagtatactgttcttttgacacaatcacattctgatgagtatttctgccaaatttctaacatgtattttatcttgtgtttccccaccctgaatgaaaggtcctcataggcaagtacaatgttttataattctttgttattatgcagcactcagtatagtgctagagaatctatttccaaaaagtactccaatcttcagaataagtcagaacagattttaacatagttctgagtatgaaaataaaataattcattagtttggtaaaagaaataagattaaatcttatttaattttataattgacataattgctgctaatatattgaacaggtagtctgaaagttttatatacagctgtattttctagaattattgaatgaatgtttgtgagtcactcttctaaaaatttagatggatagatttttaggctgttagtgctagaaaataactcagaagttatctctagtccaacctccttcttttgatgacaaacttaggtccaatgtttattaacttacttgtcttgtcatagttattgctcgaatttattctagaactcatgtttcttgaattccaggctaatcttctttttacgaaatcataccatctcttctggacagtggatactaaacatataactgctacaggtagaccttataataacataaagttatttactaaaataactctcagtgtgaaaaattaggaattataaaatcaagcttgagttaagtaccacttatccctatttatgcttatacatattcagattacaggagagggaagagaaaactcagcagaaatttgcattatgatacttttaaatacatgtattacttttagataaacagtgatcaaataaagtccttaagtccccagtggaaaatgataatataagagactgtatgaaagccaactagtatatctgtttgttgtcacatacattattgcctctaaagagcttagttaccaatatttcccttaagatgtccttttctgccagggttgtcagcgtggcacaaaggcctttaaaaaaggtcttttaaaggttgcttttaaaattaccctaaatcacaagatgcaagtttacagaccattaaaataatgtataaaaatgctggcatttacttcaactgattagaacagaagtaattctccactgtaatgctaacagtagcaatattttctcagtaatgtgttgttcctaccttatgcaggcgtgacctagagatttgcaaaactcctcaatcgccaacgcttttgtaccattcatataagaaagatagccagggatgaagataattcctggacttttgccttttagcttcttataagccaggtttggaaggtctggtcgattaaggaatgagagtgacgtcttttgtctacaagctaaacaaagtacacaaaaagtaaactatggtttgtaaactcagtctttggaaaaccatatatattttcgatcttaactttcttatctcaatgaattgatgttaaatactatttccatttaatagaaaaaacaagaacagactcaaagtactaagtaagtctgtgcatgagatctccagttttaaaatcatgccaacatcagtaacttctttgagcaaagtccaatcttgattcttccaaaatacacaatgcggtaggaatttcaagacaacaaaagacagagactaatcgaaaaacattttcttgttactgctttatcatgtattctaaacagtatcaatcaacattcagatttacccgcaatagtttcagccctctcttgtgagatttttggctttgtttttaaatttattttttgtttgacaagtttcacatcccttattttctttcttttttttttttttttttttttgagacagggtctcaccttgtcactcaggctagagtgcagtggtgcaatcctagcttacggcagcctggacttcctcgactcctcaggctcaagccatcgtcccacctcagcctccccagtagctgcactacacgcatgtaccaccacacctggttaatttttgtattttttgtggagacagggtctcactatgttgcccagactggtctcaaactcccaggctcaagtgaccctcccaccttggcctcccattgctgaaattacaggtgtgagccaccatgcctggcctttcatcccctactttcttgggggtcagggaagaaacaggtttggtctgcccttgcaaaattgtttcaaaggaggacgtgctgtgccctttttattactgactcccatccacccgcccacccatccgcctacctcaaccaagaaatcatgagccatggtaacaactcataattttattgtcagctgaggtgggttcaatgagcagtttcttttaaaacaacatatgatagtatcgtttttgggaaagagatttcttatagacctatgcaatcactttgcgttttgttggtttggctttctgtaaatggtacacagagattttagtgtaatttaagtacaacagtacaattggtgaacttcataagattatcctacttcatctttttcaaattttcccccattataaaatctatacttgctcttaagaaacaagtagatatttttttaaaagagtcatttataatcccacctcttctttccaaagacactagttttgtgtacttccttagagtctttggactaatacattttctttttttatattaaatgaagccgtcctccactttgaaaacttctcagtcttgagaagagaatccatgtgtgctgctaaagttttccccattttgtaattaagaagttgattttttaaagatgtaactgaaggccttaaagttatcctttttacataaaagcttgtttcaaagtatagagaaatatgccaaatttaaaacttttggtaaggaccagttatgctgatccactcatgttcatttcccatctactcagctgagcactaaaaaaaattctcactatcctcttccagaaatcacctcttaaaacataatttccccgagatgattataatttatttaatgtaagttctaagtagacagattcatataattatattcataaatcatctttgaacataaggattaattcaaagcctggtgcataagtgctcaatgaataagtgctaactagatgaaataatattatactctggttaatgaattgacatactacattttactaggagtatttgcatgtgtaacatgccttttggttgcgcacaattaaatgcaagttaatctgattataaaagtttaaaaactggatacaaaaatctccatacaaaagatctctgccgtgacattaattaccactccaagcaccatgcatcatctgacagctacgtggcaatggtgtgaaccacacacaaagccaaaaaaataaaaggatctaattcaaagactatatatacatataagaggttctctgatttttagcccaaattctagtttcctttgtgcaataatgattatggttctttcactgagtgggtgcagcaagaaagcagaactagaaattaggcttatgagggcgtctacacttttacaaagaacatgcctcgcattgttaggttccctaaactcaaaggagagtcagtctaagcattttaggagtcacaatctacaaattcctagaagtaactaataataatgcattaaatgcacattttaattttttctagtgttggcctttaatgcaggggaggcaggtaaggagcaggagctctttaaactgcacagtgtaaaacgccagcgagggcccggggtgcccagaatgccgcagggccgcggcagagctctcctcacagccttcaccagaagtctacaaagcgcctagaactggggtgttgagaaagggggaggagcatttttgaaccgggcgccaaagacgcactgcacaggcacggtaactgacggaacccgaggcgttcgaaagaacgcatcctactcccgcctttcggacactgacctgggagccaccgtggcgcccgctgaggtatccgtgcaagcagcacgctgaggccacggtggggaccgaaggggacggctgcccagccccagctccgacaaggtacccaggccgccacagctgccaagcgcgcaaccgccatcttcgtagttgtccccgcaccctgcagtgtcccactgagggacacgctacgcaacggaaccgaggctgcgcatgcgcttcaggctggaaggcggaacttgctaaagagctccccgcaagattttcagcttgcgaagagcgcacatgcgcagagcgtcgtggctctttcgtttagactgttggttctactagtagcggggtttggcttggggccttt

SEQ ID NO: 13254 - DNA, 86 bp, Homo sapiens; identical to SEQ ID NO: 12481
  misc_feature (21)..(21): n equals a,t,g, or c
  misc_feature (65)..(65): n equals a,t,g, or c
  misc_feature (74)..(74): n equals a,t,g, or c
  misc_feature (76)..(76): n equals a,t,g, or c
  misc_feature (85)..(85): n equals a,t,g, or c

SEQ ID NO: 13255 - DNA, 14523 bp, Homo sapiens
tacagttctgctcacggccatgatttattacagtgaaaggatacaaaacaaaatcagcaaaggaaaaaagacacatggggtgaagtcaggggaaactaagtgcaagcttccaagaatcctccgccagtggaatcacagaggatgagcttaattctcccagcaaccagttgtaacagcacttgtgaaacactgtcaaccagaaaagcttgttagagactgagtgcctggggtttttactgggagctggtcacaaaggtagtctctgcctggcacataccaaaattccagactcccagaaggaaagcaggtgttcaggagaaactatattgttttacagtttagatatagtaagctactttgatcagttctgggaatggtggaagccccctgaactccaagttcccagatgccaatcaagggccaaccttgtaaagcaggtctctaaggttaagtagtcaggtcggcttcattaacacttttttctgcacagcaattttatctcaacattttttcttcaatgcccataaatactcagtttcttgaattgtactttgaaccaggtttactatctgctggtttcctcattaatgagtcgaataagtcttcgacacatgctcatcttatacacatgtatatatatgagtcatgttgtcaacttaaaaggtttgacagataataacctaatcaagctaaataaagtccagccaaaattaattaataaaaaacattaactaaataatatcaaggctcaatctacacctcactttagttatttaggaaagaaaaaaaataacctttatactagcatttcacactttcttactgactttagaacgtcttctgatttaggtggcaatcacttgcctagttgtacttagggcaatattaataaaataatgaatgtttctgcaagaaataatatataaagattaatttcctctttaattttaccaatcagaatattaaaaatactacatcattgttttagatgaaattccccatttaaatatattatacataagccaaattttagaaatagctccttgtatcactgtacaattttgggcctttaaaaaaaaagctcaattttaagtttgaatataatgtgcagtttatataacatatatattatattatatatactttatacattatataaagtattatccttattgtgaactttattatgcttctgaaatttctccatcatttcaaatttacttcaataaaaatttccctatattttgtgaattgcattttcaaatcagaagtaatgttacaaatttctgtctataataaaaaacaaaatattcacgctttattaataatcctaattagaaaaggatgcaattaagagctggcatagctaacataagcataagaaaggtaaacttttcttgaattaaaaaaaggaaatactttaatgaaaaaaaatcaaggacagaaggaaggagaaaattttctaaacagcagctggtccttcttcacaatttgcattacttatgcaaatacatcattaaataatactcatcttatatttacaaaatagaggaaagggaaaaacctaaagtatcaggatctttcatttcttatccctcttccaatcttctggatacattagtttacataccaactaaacatgtgatactagttaactatagttgagagcttatcaattaagtcatcaatagtgtaaacaagaagttgaatgtctgctttttccctcattcggtgatcactgtgttttcggaggatgacatccacatctgtgctgagtactcgatcggcaacctgcattgatgtatgccaaggtacaatgtcatccttcatgccatggagcaatcttatggggcagttcacaggaattgggctatgtaacaagcagtgatgttcagcttctttaatgaaactgtactgaacgttataaactccttcttcagagtattttgatggcatgctccacacacctttcatctctacttccttttttagctattggaaaaagaaagaaaaataaaagtatttgtgactttaggcaacattaacacatgcaatagttttaagtaatctaatgaaagcagttcttgaataagaggatagagataacaaaagtataacaataataattatcaataattactacatgcaaggtactgtgatgggtattttatacatattattccataagattctgataataattctgttattattctatttttataaaagaggatattatggtttagataaatgaaatactgtgtgcaacagttcagggctaggctactaactgttatggctaagactcaaacttaaatttaaatttatttaattttatcatacactatctcaaatcagatgttgcttcaccccaactgaaaagaaaaatgaagagggagaaaagcactacaatttcttggaatcagtccaggtatcattcatatttaaataaaatcaaatcttagaataaacattgtttagatttcaaaattgtaaacctaaaagtgcttataagtagctaaaatggatatggcatagggaaagaagagaaagaatcaaacacagaactaagaataaaaaaataagagtaattacattgtaacaatcatacacatactcatgcaattttaggctgaatgtaaagaaatatagtttttccttccagagtcctataaaagagaaaaaatttgatttttgttctggatgacaaagaagtcttccacatacttcctgaaagccaaacaataatatctgtatatttattcccttaaaatgaaatatacatgtcctttgactttttgagaactcttattttttatataatttatcttaatttttctaaaaaaattagaattttgtataatgagtaacatgcagtcattatagaaaacataaaaataattaaagaaataaatcacccataatcctatcttatggagagaaaaaccattaatatatggcttatttccttccaatatttgtctatatgtgttttggtttttgtgtaatatgtaaaatacatacatattacacattcatatacagttttctatgctgtttatttagtacatatatttctgggtttaaaaaattctatgaaaaggttttaaatgctgcacagcagtccaccataattgacttaattagtttgaccatctcatactgtggtattgtcatgaacacttttgagcataaaagtttatttatatataatagattattggaaagatgatcacagcttaaaactaaaacaaaaatcaagctatgaatagtttcaagactgttacaatcatataatattaagggcatttctagaaaaatggaatggacatcttatcaaaaattttaaaaaataaggaaagaaaagctacacatatttgaaaaatttaaagtttcaacaaatatactatgattttcccatgtttaaaattgttaatttattgcaaatgtaaaaaggaaaacaagaacttaaaaaatatgtatgacataatataatctatatgtacttaggctttaatgtatttttaattccaaaaagacttaataattcagtaaaaaaaaaactgtacttctaaatatgtctccaaatgatttaaaattaatgaaattctacaaaactataaaatgtatataaatctatatcaatatcatggcattctctgtattaaaacaacatatgaaccaaatatttaaagtaaagatgacatttagctatcctcaagctactcaggattgtttctgaatttgtaaatacttcagcagatagaacttagtcccactggttattagctgaagtggaggctttgctaattaaggcgacactgaattaataatagtttcattttaagcatccctggcccccaactagctctgctacctgccactgaattgaatgaaaatggtccatctgaagaacaaagttaactttataaaatgttgtatgtctcaagtcctcaagaacaaaaagttcagaaacagcaaagacattacccaaagaaaatgtacaatatattaagttctacatcaacaaaacttatcaaggcaatgtggttcagaagcttacattcccaacagctgtgcatcatgtctgaggccctctagtgtccaaagaaggtgataatgattagagtcagttaaagaggatggtcaagttcttagagaagaaatgagaaatgctgggcttactattcccagggttataaaagatagtaaaaatctccacatctgctccgttgacattgttagggctagctgtttatgtggagaagagatagcggtcttagtgttggtgctctttccttatacatgcttttaagttaaccaagggctcaacatgcttctgttaacaactgcttatctgagtaagtattagcaaaaaatgccttgatttgcagattataaatcttctcaattagaaagtatctaccctatgctcactctgactgatgtgaacacacacacacgcagagaaatgtacatggccaggcacagtggcttgtgtctctaatctcagcactttgggggtccaaggcaggagaatctcttgagcctaggagttcaagaccggcctgggcaacatggcgagaccccatcgctacaaaaaatacaaaaatcagccaggcatagtggtgtgcacttgtggtcccagctactcaggaggctgaggtgggaggatctcttgagtctgaggggtcaaggctgcagtaagcaatgactgcaccactgcactccagcctgggcaacagagataccctaaaaacccccccaaataaaaacaaaaccaaaacaaatgtacacaggttttgtcatttaccaataattacaaaatacaataaacccccaacccccaaaaatcaactccttttcaatctgctatgtctttgagataatttcctacccaagaagcgctgtattattgagttaagaggatggagcaaggagtccacatttagatccacaaaatgtcaaaggtgggaaaaacatgaagacattgagcaactatgtatgagaaaccaccaagaaagtgaacaaaattcagaaacaggagataagttcaaggaagaccagctttgtaatttcagctctgataggaaataatatgagaaacctgaatacacacacaatgctatttcttaaggagcttaaaacaacgtgaactaagaatgaacttagttaatatatggcacaggtattaatgcagaacttgaggcaaatcaatgacattctactattcaacactgcatacgttttttcttctttttttttaaatttctgaacctccttctcctcttcccccattctctaaagcattgttctcaaactttacaagaggtttgttaaaacacagactgctgggccatacccccagtttctgattcagggtaaaacccaagaatttgggtttctaacaagttctcaggtgctgctgctgctgctagcctagggaccatattttttaactactgctctgttttctttaatttctgtgtctctgtcactctgactgacaatatctgtctggagagttctgttgggaggaactgaggctgcttttaggctaaaacaaagacagtcagctctccatattcatggtttctgcatccatggattcaactaactttgtatcaaaaatatctggaaaaaaaaggttacctctgtattgaacgtgtacagtctttttttcttgtccgtattccctaaacgatacagtatagcaacaatttacatagcgcttacattgtactaggtattttaagtaatctggcaatgatttagattatacaagattatgtgcaaatactacaccattttttttctcagagacttgaccatctgtggattttggtatccatgggaggtcttggaagcaatccccttcagataccaagggatgactgcagtttcagttcattagcccactctaacatagtcataagaacaggcactactccccatatgccacaaagtaagaggaccaaaaggagatcacgatgtatgattcaaataagtaaatgtaataataaagaaaatgtggctaaaaaaaaagaaacttcaaagtgtgatattgttaatgtgtctcaaatatttggcagaatgatttgaagagactatgaagaaacgaaatcttaaacaagatgacaaatagttaaagatagaaaagaggttgtgtacagaaaggcagctaagacaaaagttgggccagcacagtaagtcaaaggaattattgttttctgtccccccttccctcaaagaaagagggagcagaagaagtataagcggtaaatatattgaggtggcaaaagtgacttttgacttacctcaacaggaagctgattaaactttgtcactaaggtatctgcagctgtagctacaccaataagagccacgaccttctctggtcgtgcaattgcagcatgaagcataagccaccctccaaggctagatccaacaagaatctaaaaataaaataaaataaaacattaggtctttaagatagaacaggttataaacataaaacaaaatatgtacaataaaaaattagaaagtaaaaatagaatcattttaaatcaaatatcaaaatggattaaacatttaaattaaataaaaacattttcatatctaaagaaacagcttaggccgggtgtggtggctcacgcctgtaatcccagcactttgggaggcccaggcgggcggatcacgaggtcaggagatcgagaccatcctggccaacacggtgaaaccccatctctactaaaaatacgaacaattagccgggcgtggtggcgggtgcctgtagtcccagctacctgggaggctgaggcaggaggatgccgtgaacccgggaggcagagcttgcagtgagccaagattgcgccactgcactccaggctgggtgacagcacgagactccatctcaaaaaacaaaacaaaacaaaacaaacagcttaaatacgaggttacagtaattatcatcatacttaacaaaacagtcacctgtggcccatcagctaagtcatcaattatagaaagaacatcttttctccatttccccagtgtgctttcctctgagttaccatctgaacttccaactcctgagtaatcaaacctggaaaaaggggaaaaaaatctatatctaaatatctatatatctgcttctttaatttttaagaaagatagcaccttcctcattactataatgcttatagtgaaacatcacaatcaatatgtattttagcaaattctattggcttattaactttcaaatacctcctgtgtccaatcactttctcacctcctccactgctaccagcctgttgctagtcacactgtctctcaacctaactgaatgcaatagtctcctaaaaagtctcctgtttgcattttcacactcattgtctttccctatatagtagagtgatccttttaaaacaaaaccatgtcttgcaaaccctccaaaggctttctataatctttaaatccagagcccttaccatactttggtgcctgatcacctctctgatctcatttctcattgttttctctctctccctccctccctcccaactgtatcttcgctttgcttcttgaagctcccatctcatcagcttttctctccacatggcatactctcctccagatagccatttagattgctcccacacttcattcaggcctttggctcaaatattacatcctcagaaaagcctcccatgaccattcaattattaaaactgtgctgctttcatcattctctaattctttactctgcttcattttcttcatagcacttattactacttgagatatatttgattatttatggtccatctcccacattagaatgaaagttccacatgggcacaagctttgtttcaatgcgttcctagtgcctagttcagttccttgcgagtggtaggtgcttagtgtatatttagtgaattgatggaagggaaggagaccagaataaaattcatcatcaccaacccatccctttctccttccaacttcctagttatctaggctcagttatctgtctgatctatgaattttacctctccttaagggtatcaaatcaataaaaaatcatggtggtataaagtatcataccacacccacaggttacctaaactctagtcatactgaactactcctaattcccagttacacccttttataacttagagccttagcatgctgttctgctgccaagaacagcttcctccccaacccaaattcgtagtcaccctttaagtcatgtcacctcctctgaggaacttcacttgacatatatgccccatttagtaccagtcactttcttttgtatgtactcaacacttttcatattgtattgtaatcaagtttgtttttaaacattcatctccctctgactagaatgtcagttccttaagaggaggctgttttattcgtttgtttttccaggccacagaatactgcctgccctataccatcaccattctttctcatttcttcttatgttcatccctttcttggtactttggtaagtccagtatcttggtgtaggtgtttatttgtcatcttagacctagactatcacagtagccttctatcttgtgtctctatgactctgtctttaaatagagtcactatatacatgtcagtttttttctttaacattttagcattaccttcagtgctccctgtgatatacaacataaacacttagtgctttggcctgtttttttgaaccattatattctggtcatttcagattgatttcacaataaattttacagtaaatttttttttactactaaattttacagtagtactcacttcatcagggaatactactgctttagacaaattgatgaacttactgttcctaaaataggtctatgttttcttatgtgtttcacatctcacactgttgattcctttacctggaataccttcttccatcatcttctttactgatatattttcccttctttactgatatcctttcccagagcctagttcaaatgaacctttttggtggaatggctggtacagtaagtaagggatttatgagaaataggggagagaagaaattaaatttttctttaggtttgaagtgaaacgattttggatccttgggaaatagaacagggcaactggtgcagtctaaatcagttactgtttccccctcaatccagggtatgtaagagatgggtagaaggggtggaagaaaaaagggggaaagacaccaactaattttctccttttctctcttcataggtggcaattggatatggctgaatgtggcatcttttacagttagctgccttccaaatatatggtgaggatgcaaaatacttgtacagctccttcatgaaggaaaatataaatacttggtgatactaacagggtaccattaaaaaaatatagttaactctcactgaaccccaatccagagacaaagataatccaaacatattcagcactttaaaacttttaaacagtagcacatctccatcttagcagcctcaatagtctgggatgtagtcccaaataaaaattctattacaaataattatgagagaataccagccttaaaaccatatgttatattcctgagatctgaatcagtcttattttaggcatggtgataggaccttaataaaacattttcatatagtcatatgttttatttcttgtgtaataaactatttcatcattgaagatctaaattttacagcaaaaaatcccaacaaaagcaacctgaaaaattagagaatagaagataaaatctcttataataaagtgcaatcaatagttaacaataattagactgtgatgaactttgataagagcaaataaaatggaacttgttcaaactaaatatttgtagttaagcactattctttatgaaggtatactcacacaggatccaaaaatgcagaaaagccacattatgtcttatagggagacaggaactggttataactctcatagtctcaaagctgaaattttagaactggtaaaatggtgatttctcgattcaaatttattcagtggcaaaaaagaaaagtgataacaatatttttgatattatgatcttctgctcaggacagtccccctccttggacagcacttccctcccacccaaatctgaattattcttcaacgttcctttatctatttcaatcccactgtctctaactttatgcaattaagtatactgttcttttgacacaatcacattctgatgagtatttctgccaaatttctaacatgtattttatcttgtgtttccccaccctgaatgaaaggtcctcataggcaagtacaatgttttataattctttgttattatgcagcactcagtatagtgctagagaatctatttccaaaaagtactccaatcttcagaataagtcagaacagattttaacatagttctgagtatgaaaataaaataattcattagtttggtaaaagaaataagattaaatcttatttaattttataattgacataattgctgctaatatattgaacaggtagtctgaaagttttatatacagctgtattttctagaattattgaatgaatgtttgtgagtcactcttctaaaaatttagatggatagatttttaggctgttagtgctagaaaataactcagaagttatctctagtccaacctccttcttttgatgacaaacttaggtccaatgtttattaacttacttgtcttgtcatagttattgctcgaatttattctagaactcatgtttcttgaattccaggctaatcttctttttacgaaatcataccatctcttctggacagtggatactaaacatataactgctacaggtagaccttataataacataaagttatttactaaaataactctcagtgtgaaaaattaggaattataaaatcaagcttgagttaagtaccacttatccctatttatgcttatacatattcagattacaggagagggaagagaaaactcagcagaaatttgcattatgatacttttaaatacatgtattacttttagataaacagtgatcaaataaagtccttaagtccccagtggaaaatgataatataagagactgtatgaaagccaactagtatatctgtttgttgtcacatacattattgcctctaaagagcttagttaccaatatttcccttaagatgtccttttctgccagggttgtcagcgtggcacaaaggcctttaaaaaaggtcttttaaaggttgcttttaaaattaccctaaatcacaagatgcaagtttacagaccattaaaataatgtataaaaatgctggcatttacttcaactgattagaacagaagtaattctccactgtaatgctaacagtagcaatattttctcagtaatgtgttgttcctaccttatgcaggcgtgacctagagatttgcaaaactcctcaatcgccaacgcttttgtaccattcatataagaaagatagccagggatgaagataattcctggacttttgccttttagcttcttataagccaggtttggaaggtctggtcgattaaggaatgagagtgacgtcttttgtctacaagctaaacaaagtacacaaaaagtaaactatggtttgtaaactcagtctttggaaaaccatatatattttcgatcttaactttcttatctcaatgaattgatgttaaatactatttccatttaatagaaaaaacaagaacagactcaaagtactaagtaagtctgtgcatgagatctccagttttaaaatcatgccaacatcagtaacttctttgagcaaagtccaatcttgattcttccaaaatacacaatgcggtaggaatttcaagacaacaaaagacagagactaatcgaaaaacattttcttgttactgctttatcatgtattctaaacagtatcaatcaacattcagatttacccgcaatagtttcagccctctcttgtgagatttttggctttgtttttaaatttattttttgtttgacaagtttcacatcccttattttctttcttttttttttttttttttttttgagacagggtctcaccttgtcactcaggctagagtgcagtggtgcaatcctagcttacggcagcctggacttcctcgactcctcaggctcaagccatcgtcccacctcagcctccccagtagctgcactacacgcatgtaccaccacacctggttaatttttgtattttttgtggagacagggtctcactatgttgcccagactggtctcaaactcccaggctcaagtgaccctcccaccttggcctcccattgctgaaattacaggtgtgagccaccatgcctggcctttcatcccctactttcttgggggtcagggaagaaacaggtttggtctgcccttgcaaaattgtttcaaaggaggacgtgctgtgccctttttattactgactcccatccacccgcccacccatccgcctacctcaaccaagaaatcatgagccatggtaacaactcataattttattgtcagctgaggtgggttcaatgagcagtttctttaaaaacaacatatgatagtatcgtttttggaaagagatttcttatagacctatgcaatcactttgcgttttgttggtttggctttctgtaaatggtacacagagattttagtgtaatttaagtacaacagtacaattggtgaacttcataagattatcctacttcatctttttcaaattttcccccattataaaatctatacttgctcttaagaaacaagtagatatttttttaaaagagtcatttataatcccacctcttctttccaaagacactagttttgtgtacttccttagagtctttggactaatacattttctttttttatattaaatgaagccgtcctccactttgaaaacttctcagtcttgagaagagaatccatgtgtgctgctaaagttttccccattttgtaattaagaagttgattttttaaagatgtaactgaaggccttaaagttatcctttttacataaaagcttgtttcaaagtatagagaaatatgccaaatttaaaacttttggtaaggaccagttatgctgatccactcatgttcatttcccatctactcagctgagcactaaaaaaaattctcactatcctcttccagaaatcacctcttaaaacataatttccccgagatgattataatttatttaatgtaagttctaagtagacagattcatataattatattcataaatcatctttgaacataaggattaattcaaagcctggtgcataagtgctcaatgaataagtgctaactagatgaaataatattatactctggttaatgaattgacatactacattttactaggagtatttgcatgtgtaacatgccttttggttgcgcacaattaaatgcaagttaatctgattataaaagtttaaaaactggatacaaaaatctccatacaaaagatctctgccgtgacattaattaccactccaagcaccatgcatcatctgacagctacgtggcaatggtgtgaaccacacacaaagccaaaaaaataaaaggatctaattcaaagactatatatacatataagaggttctctgatttttagcccaaattctagtttcctttgtgcaataatgattatggttctttcactgagtgggtgcagcaagaaagcagaactagaaattaggcttatgagggcgtctacacttttacaaagaacatgcctcgcattgttaggttccctaaactcaaaggagagtcagtctaagcattttaggagtcacaatctacaaattcctagaagtaactaataataatgcattaaatgcacattttaattttttctagtgttggcctttaatgcaggggaggcaggtaaggagcaggagctctttaaactgcacagtgtaaaacgccagcgagggcccggggtgcccagaatgccgcagggccgcggcagagctctcctcacagccttcaccagaagtctacaaagcgcctagaactggggtgttgagaaagggggaggagcatttttgaaccgggcgccaaagacgcactgcacaggcacggtaactgacggaacccgaggcgttcgaaagaacgcatcctactcccgcctttcggacactgacctgggagccaccgtggcgcccgctgaggtatccgtgcaagcagcacgctgaggccacggtggggaccgaaggggacggctgcccagccccagctccgacaaggtacccaggccgccacagctgccaagcgcgcaaccgccatcttcgtagttgtccccgcaccctgcagtgtcccactgagggacacgctacgcaacggaaccgaggctgcgcatgcgcttcaggctggaaggcggaacttgctaaagagctccccgcaagattttcagcttgcgaagagcgcacatgcgcagagcgtcgtggctctttcgtttagactgttggttctactagtagcggggtttggcttggggccttt

SEQ ID NO: 13256 - DNA, 143 bp, Homo sapiens; identical to SEQ ID NO: 11520

SEQ ID NO: 13257 - DNA, 116 bp, Homo sapiens; identical to SEQ ID NO: 11521

SEQ ID NO: 13258 - DNA, 9038 bp, Homo sapiens
aactgtgggttcatctcatggctgactcgaactggaaccttctgaccttcacagggggactatgttggagttcagagtaaaggaataggttggagaaatcgggtggcaggatgattaggtgacagttatacacttcagaccacagtgagtctctaactgcaagctgttgaaatggtcaacatatttacttttcttttttatttacagggaaggagattggtgggaagcccgctccttgacaactggagagacaggttacattcccagcaattatgtggctccagttgactctatccaggcagaagagtatgtttcattttgttttcacttaactacttgattttaaaagttgattgccgcaataaaatgccatcagcattgggcaggagggagaagaaattcacagcagtgattaaggctgagtttttcaggctttctgccccggtttttaccctgtgtaatacttgcactattattaacttaatgtttctcttgaagcctgctcacttattttgaaagaaaactttctatcaataccctaaatgaaaagccagtaaaacttgtcatagattaaaagtagccataaaaatatgaaatgctagctagagcatatattattgccaacccaagtttctaagcccgcagtccactccctctgttgggaagagaggggagagtagcaagtaattgccacagattaaactaagatttttctcctaagtgtgatcagaaatattaaaagagtgctgaaaagacaccttctatgcccggtaaaagtgactcacatacagtgtgtccccccaacttgggaaatactacagtgatttggaacctcagttggcttctttggtagtaaacagtgacgagcagttatttggcccaactattcaactggtagcagtttaggaaggtgttcagtaggctgaagggatctaaaagggataacctttctcccttcttctgacccatgaggattaacaggcactcccaaggggaagaactgccagtggctgtttgccagccctgagggaaggagagatggagccatgatttcccaaatgcaggaacttggcctcctcctgacaccttgggtcttgcctctctaaaaaggaagttgagaaaagtcagtcaccaagcccaacctttggctctgctatttaatttcaccatggatttgtttaagtagtgcaagagggattagactccacaccctagccaaatccccagttggattgttctattctttaattcctttgtatttcctctaagaggatctgttttgtttcccactctcaaatactcagtggttcttagttgtttctttctcctagtgactgtgtttcgtcatcagtgaatcaaggtatttgtatttaatttgtattttagggcagatttgcaaacatctttgtgttctttcagaataaaaagtaccaccaaaatgtagcattaccctgatttaactgggaatttgtcagctatatatttaagttatttttataatggtcaactttttaaatattttgtttttaaagaatattattttttaaaataatgccttcggttttacatatgcaattaactatcattatcttaaaatactattgttttggtgcaatccattgttctaacaattcctttttcaccactgttttacacggcattctaattgggttattggtacaaacccagaaagccatttctcacaaataattgacgtactagtctttacgccacctaatgctagattaagaattgttgcacattttggtgtttctaaaagtcactgaggagctaatacgcaatgtctcttttcttcagtgaaacttaattcacaaaagaatttgacagtgaactcatgatacctatattcaagcataatgaattgaaatttcattttagaatctggattctttcacagttaaatattctaaaaatggttcccacacacagattccaattgaatgctccagcattctcccttgggttttgggggcacctgctgctcattcagcacctagtgctgaaatagtaactaattgccaggcttggttaaggcttgaaagtgcagggggaggatataaggcaaataacaaaagtcttgaggtgacttaatgtgatgcctcctaaagtggcacagagtatcattagtttcttcagggataatatattgaaatatctgcaacaccaagtcattttaagggcatgctttttgactgggcacagatctcaaaggtgtacagtaaccagttcttacagttgtgccaaagaaaagatgtacagggtccaccgtgatggctccctcctgtaatcccagcacttgggaggccagggcgagaggatcacttgagcccaggagtttgagaccatgctgggcaacatagggagacagtctcactctgtccccaggctagagtgcagtggccctgtctcagctcactgcaacctccacatccctggttcaagcaattctcgtgccccagcctcccgaatagctgagattacaggcacatgccaccatgcccagctaatttttgtattttcagtagagttgggatttcaccatgttggccagggtggcctcgaactccagacctcaggtgatctgcctgcctcagcctcccaaagtgctggaattacaatcatgagccaccactcttagcctctacaaaaaaaatttttttagttagcaggtgtggtgatgtgcacctttagtcccaggaggctgaggtaggaagattgcttgagcctggagaggtcaaggctgcagtgagctatgattatgccactgcactccagcctgggtgacagagtgagaccctgtctcaagaaaaaaaaaaaaaaaagaagaagaagatgatgaacacagatcacaatccaggtgcttggtaaataaatgcctttacttatccaagtcctcacacacctaggggaggaaaacaaaatacaagtaagtactcatgggcgtttttctcagaattcttatagggaggaagttattgaaaatactattcctttattcatatcatatctatctaatctgactttttttaatgcttgattatcttcatatacattaagactgtgttttgttatttcccagcagttacaataatgcttagatatcaagagattcaagagttttgtttttttgtttattttttgttatgagacagagtctcgctctgttgcccaggctggagtgcagtggcgcaatcctggctcactgcaacctccaccttccagattcaagcaattctcctgcctcagcctcctgagtagctgggattacaggtgcatgccaccacacccagctaattttttgtatttttagtggagatggggtttcaccatgatagccagcattgtctccatctcctgacttcatgatccacccaccttggcctcccaaagtgctaggattacaggcatgagccaccatgcctggcgtttgttttttttgttttgttttgttttgagacacggctttgctctgtcacccaggctggaatactatggcacaatctcagctcactgcagcctgggcctcccaggttcaagtgattctcctgcctcagcctcccgagtacctgggattacaggtgcccaccaccacaccaagctaatttttgtatttttagtagagctggggtttcaccatgttggccaggctgatctcaaactcctgacctcaggtgatctgcccacctcggcctcccaaagtgctgggattacaggtatgagccaccatgcccagactagagtcttttagataagtgtggaaagggtctcctgcagtaaccatttcaaatcaaggtcttagatttctggttttttgcatacaggtggcagttttaacacaaaccagttctggtcatgtctagaggggaggaaaacaacccacaactcaaatctgattttttttaaagagtgaaagagatgaattagggatagaatccaggatagattgaaaaggaactgaattaagctagaaaaaaaatacatccagggaaaggttaaggactaaattggaggagaggggaattcatgggcaaaaaaaaagcctatgctgttgcattttgtaaatgactatttcaaaatattttctttccttgatctaatttaaaggtggtactttggaaaacttggccgaaaagatgctgagcgacagctattgtcctttggaaacccaagaggtacctttcttatccgcgagagtgaaaccaccaaaggtaagataacgagttgaagaagttggcttgtcattcaaatctgtggattagtcagaggggatgaaaggcttatctctaatgtacaaggattttaaaatggcacataccctccctgccttgtgagtggagtcctgttttcagtcttccctccaggctctaaaactgcagacagcaccaaaagaactacagaggccccaaatcaagaccttcctcctgaaacgggctggatgcagctacactgctccaggcacacaagatcgtagaattttcagaagtcctttagaattttgattttctgaaatcttagttcctcaggtgccagtcatacaggttgtttttgctttccttttgttttttaaataactgaggacttcacttctcttcctccaactgttggacttttcattatttaacaactccttacaacccacaagaggagacaggtcaaggaagaaaagagtagtggcctctagcttaatttgccagattatccattcctgtaaaaagtgttgtaaagcagaagcttgaagctcacttctagagaaacaagccttagatttcttttgcacatgctgctgctacctcccagtatgcccctgggtagagaagacaagggaagcaagctcagccattcatcgtggtccttctttacccttgggggaaaggagtgttggaattgagtctacgctgtattatgcaacaaggggtaccgaacagtgtgtttaagaaaaatgtccaggaagctttcagtctcaagggcagaatcattttattgctaatatattctgacatttgcagaacatcaagaagcatcttcttcctgttactgagtggagatgctgtgtgtgtgtacatgtgtgtgtgcatccttggtaattattaatcagagtcaagaaaatgaggcctaaaaagcaagctgatactctaaatgattggagctgctaatgctttccacgtttaccaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcaggtaaccttaattctaactacctactaaccatttggatgctggagggagtggataggcccagagcaggaaagtggaaaggggtaaaactaatatgtacaaaatcacttatagagtatgttttctttgccagcccttaatggtagggcttggctgtataggttctattgctattgttctactggtgttattattagttccacatgtttgtccgaagattctataatatttttgtttcccaagtagaaagcaataggttaaattttaaaagttgtttgttttttcatcttcaagttgtcttttcccattccccgcgttgcatgtgagaaagcagtctctcggagggcgcttacatggggactcctacaaggaatattgtgtttccactatcactttaccctcagcactgttgcaggaatagctgcacgtacatttcattctcatgcaagccatttatcatgttccccaccaatactgctgtttcctaactaggcttagacttacacaacccacagctcttagatctattatgtctattgtgttaaattaaacttttataatgtacatcagtttctgtcctaacacccagatatcaccattattttgttctttctgaaaacatataattattagatatgcagtttatacattttatcaaagactggttttatgtgcaattgttaaaatgattgctttctttcctagattagcaagtattatatgccactatataatacatgttcacatgtgcctatagatataggtgcacatgtatagacacatgtctatatcctattaagcctagagatatttttttgtgtgacccatttctccattttctattgttctccaggacaaaggcaagactcaaaaatagtatatgatttacctctactattgctctgtgcacaatcattgaaatatgtatgtataatttttggcatgaaaaagcaatctttcgaaaatgacaataagaaatgtctgttgatcccttgcactaatgaacaatagaaaatattaacagcacttgcagtactagttgattatggcattggctaactcggtttatgtggattctaatgaaacatttgggagaaatggaacaaaatatctccctgagcttaagtgatatactcaaaatgcctgcatgttgtaaggatttttcaaatgctgaaatatatttcattacagccaaacatcagcaggatccccagggtttggatcatttgaaaatactgtgttcgaaagggcaccttaataacattgtaaagctggaaggaaagaggggatatgaacaatagacactttttttaatctcggggaaaaaaaatccatctcacgttagacttgtttttatattggctttccctcttccctctttctctctcacacaataaaatgcctttgaaatgctgacacataaataatttcctacctaaacatctcagagcctgattccatcaaaaagaaaggagtaaaaagcaagttacagcccagcagcacatctgctttccctgggtccgggggctgccaggagggagcgggaggtctgtccacctcacaaggcaggctctgtcagcttttgtcactccctgatttcttattctttgttaccttttttcgcctgactgatttttacttggcatttaagttccccttagcactgccagattctaaaaggttatattctttttaaaaaagaagagaaagaaagaaggaaagaagacaaagaaagaataaaaacctccgagtgttaactactttttcctttcttcttttttttataaagaatacattctttcacatcttgaatttctgtgaattttagtttccattctttctcctttcaaaccagacacctaaattatacgtcgaagactgttaaaaagttgtttttttttttttaatggaaaatatccaagaagcagcccaggagtatctgacatggtggaatggaatcagttagaaagcgaagaaatcactaaaaaaagttacttctttttttccccaccagttataatcttcaaccttactagtttataacagtttaatgtcctatagaaggatcctccactaaagttataattttaagtatagtcatatagagagatccctaatcccctgggtaatctagatactaaaggtggggaagaacagtcatattgacattctttaatccaaaaccactgtttgaaattagtaaggatattttcagcattcccaaaaacatgttattagcacgttgagctgaaaacgtttttcttcctcagtgagtacagaaaccaaagcagtctgcgtgtatgtctatgtatagactgtatcgtacctgggctcatggagtagtctaaatttaaaacgtcctctcttctacctccaatgaaaatgtttccgtgtgtggcgtctgatcttccaccgtgtgtgtggtcgtctgctggtgtagcgctgtttaaggagcgctgtgtgctgctagtgttccacgatgtgtgtggtcgtctgctggtgtagtagcactgtttgaggagcactgtgcgccgctagtgtgggtttacacttatgagtgttgtcattacatgtgttctgctcttctctccctctcctgcccctgccctgctccatcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtatgctgagactcaattactctcttattagcttccccgtttggaagatcccaaacaccaaagatggaaggtgaaaataaagactgcgtgaccgggaagaaagtttgaattactaatagtggggaataataatttcagttttggttttaacattctggaattcctaaaaaaaaaaaaaaaaaaaaaaaaagatagtaagtgggcaaaattggcaaatggctcaagttgtactattacatgactctcaattcataaaccagcaaatggtccaaggaatgttccagctgccataaaatatcttgctcttcatttccaaaagcaaatatttgttgagtgtcatcctaacgggcaagtcaccttccatctttcctagtgcatgcataattatggattataaggactgtgttttctttattaattccctttcctgtagagaaagctgatggtttgtgttttaacttaactgtgattgcatcgagttgtaccccacaaacttctggattggctaaagatgcttgggaagttgcacgtcgttcgttgtgtctggagaagaagctgggtcaggggtgtttcgctgaagtgtggcttggtaaggcagagggcacattttgttttggctgcatctcaaagccgattaaaaggatggttttgaacaaaaatgcacacacagccgttgggacaaagacacttaacctggataactagacgggcacaggccatccagattttcagaatatgctgataccttgctgtgctcatctgtcctacttcatgtggttaattaaggcacccgcagaacaggaaaccagtacactatgaatctggtgtttcctcttcctaagaaatgggaaggtaagatactgtatatgggcagccataagaaagaccatggacgttttgctcaatgggcctgg

SEQ ID NO: 13259 - DNA, 576 bp, Homo sapiens
ggaggagctgggtattgttatttttaatgatgaaatgtctccatctagtggaacttcagagcagtaaaccttgtcactatattaaagtgaagattatgtctccaaagccattttccttaaacacatacagtgtttaaagaaaaaaataaacttccacatatgttcttagatgatatccttacaactgtatgtattccttttggaaggcatagaaatgagaccagtacaaactgttaacatttttaatgtcatgatttgaacctcaaagagaggggtgcttacaataggggagcagcacagtgcagatcccacccagttggtaacgatctagctcttaagttgggcagtgggttcacggggttcatatatactgtacctatattcttcagtatgtataaatatttcctaacaaagatctagacatgaactaaatttaagattatgaataaatctagacatgaactaaattttatgaataaagaactttctgaatatgagtactgtacttttgctggatttgtaatagggtaaaaaggagagattaggaaactaaattaaagcataaggttttaaaaa

SEQ ID NO: 13260 - DNA, 20869 bp, Homo sapiens
ccaggctttacaataggatttaatttgattttccaacaatcctgggagggaggtattattaaccccatttcacagacacggatatggggcttggagaggtcaagtggctttcccaagatcaagcagggagtagagccagagccaggatttggacccaggctgggccaacaccaaaacccatgccttcaaccttgacaccagcctgccaaccaaagacaggagaagggaaggccctggaggtgagctgttggcagcagtgaacttgctcgagctccctcgggaaacactgttgaaaggaacatttccaaagccatccaggcccgcacctctctacattcccaagcacaaggcaaaaggaacttggatctgaactgatgcagacccgttctttcccaacaagtagctcttcaagtgcggatgtcatctttcccaaccccatttgcgggtaaaccttcctctgtcattgcaggttcaggcttgtgaatcccagaggacgctgtgtgaactgggtctatgaaatcggcactgacagcagccagccttccaggggatgggggagggaagaaacagcagatattttcccaaggttcagctttataattttcttggaaatttccgagcagccaatcagctagcttctaaatagtgtgggtctctcctggacactgcaggcaaaagttcctctatctgctcctctttttgtcctttcttggagctcagtgctcatgttcactgttcaagaaatgggccaatcatactcccaactagggataatgtgcatcatacatacttggaatacagtgtggtatcattattccattttacagatgaagaaaatgaggctccccaaagttatgagtttcaggggcagagtttctcctcacctcactctaggccagagtgatctccttacagaatctgtgattttcaggctggatcacagaactgttgggttctgtgggccagtgagagaaactgggggatatcaagcaggcaggcagggtctccagcctgaccagccaggtgcctgctacaaagcaacacttgatgaatagctgttgaatggatgtatgaatgaataaatgtgtcaataaatgcttcagaggccccttttatccatattggagctccaggtaggacttcattagaaaaaaagactctgtgatgtaaaagcaaagtctgagaaccacagtactggagtagaccatggtgacctcccagttaccagcagattttcagtgcagagcagatgttgggagggtggagagaagagagtgggcagggggagatgacctgaggaagctggagctatagctggcaactggatcactagacacatgggaccattgcatcattctagttcaaaagccctaaatctgtactccttgggcaccctgaatactaggtaaaactttgtgtctagacacttttttaggcagaagatacaaaattctcatcagattctcaaaggaaaccttgacctttaaaaggttacacagcattgctttaagatactatctaaacatccacagacatgggcagttgtcataaagagtctgaactttatctatttcaactcttcattttatagccaagaatatagaaagaaacggcagatgacttgcccaaggccacctggcaggtttgtgggggagagctttccaaattaagacatttaactgagtgcttgctcaaatcaggatttggatctgggatttagtatggtggtctttttaatacatcaaggattcttaatctgacgtctttggttagacttcaggatctatgaacctactgaactacatgcaaaattgggaggatatgcattttttctatggaaagaagtaggtgcttagatcagattctcaaagagatttcgggcccaattaagattagaaagcactacaatcctctaggtcagccctcagccctgccttccctgcagaacctggagaactcctgcgtagagctgctcctgttctgaactttgatcagaatgggggtgtatgtacgtgagggacagtgttctctcctgcaccatgtgtcccctcctgatgagctgataccagcacctttcccaataacagctcagagtgagaccgtgtctatggtaacagaactgggtgtgttgaacaggaaggttacagaaatttcttgacatcagccaagatgtcaaagctgagactttggacacgctcaaaacagtttccaccaagatgggctctgtcccctgggagactgagggagcaggcgagccagcaagcactgttacatgtcgtcctaatttggaaagcatagagggacattttttaaatcaatagtcagccgttctccagcaccaggagtgcaatgcagtgctcactcagagcctggaggcagctcagagattgacaggcagctgccttgtctgtcacccaacttcagtttggcagctcactgacgctgcctcttctctggctgaaataagagtgatgtggcaaccactacctttgaaactctggagagaaccaaatcccaaaaaagagaggacaggaggaaggagaggcttggcctggcacatagtgtgtacctagaaaatagataagcattttctagctcctactaaattttgggtacaacgtgggaggagtaggacatgatcagaaacactcatgcaacaaacattttgtgtttattgaataattactaagtgccagaagtagcacaggaaaccgtgtgtgtgtgtgtgcgtgtgtgcgtgtgtataggcggcgagtggggggcaatacagaattattcattcaagttatttaaaattattcattcaaattacttaaagtacctactatgtgctgggtaggcttggtgctgggcattgggtggggggagttgagtataatcactcacttatttgttgaatgtatatttactgaacatctgagtgccccacactatattagcactaatgatatagtaaaccaaatagccttgttcccatcatagtgtcaggactccctgaaaacagcatctccggatagggaaactgaggcagtagagcttcccacaaaggtctcattggtgagggcgccgggctttaacccagcatcctgacccaagctggccctgctgatgggagccacctccctctcgtcctctcacacttcctctggggcactgatgatgagtcattaataacagaattttaatggcaaaagcacagcagtacccagctctgccagtgaagcccatccccctggggctggatcaagaccgcagtgactgaacagccaaggatttttggtcccttgacaacacctttctcacgactctgccatccttccctttccacaggagaggcccttcctttttaaattggagagcttaaaaatatcctacccccaacctttggcaccccaaattgaatcagtacttagctcagtagtgactgagtgggagggagagccactcagggagggctgcatctggccttcaccacaggacgcccagtggccagactgtgaaccagccctcggccccagctatggctagaaggaagtagtcagaaaatccaaaatgaccacagaggggaggaggctggggagtggggctccacagggagggcacacggtgacatttcacgcagagggtgccccaggaaggctcaaaagcaatctgtagggaaacgggctctgggctcaattcagtgagagaaaacattgggttaaccaagttctttactggaggacttcttggaacctcaaatatgctgatgtgtattgtgaatctataaaaaggggacgtctggtgcagcatttcccaaacttatttaaccacagaaacctttttttgtttgttttttggcagagagcttagtgcactgcacagcttaaaaccctgagcttgaaacctcaggtttcctaccctgcatggggccttgcactcagtgctggggacactggaatacaaagacaaggaccctgctcccaaggagtgccatctgtggaaggtggccatgtgcagggtccaacagtggtgagccagtgtgcagggcagccctgaaaaggaggcagggagcaggcgaggagatggagctagaggacgcttgggctccccgggtgaaagagaggtgctaggaaagtatggcaggaccactaagaagttgagagagatggggtgggaagcagagagggaaacgtggacaactttcccccctcaaatcttcttgcctttgaattggccaggctggttggtctccactcagtcatgggattgtggggggtgggcggtgggctctctatccctcccagaccccactctcaaccacatctatgctattcaacttgggctaacatccagaagccagggaatagctattcacaaattcagtaactggactcattagcactgactcagaaatctttttttttcctaagtctctctcctggagaagcttttaagatcctttaaattggttagtggagagtttagagatgaggacggagcctcagctttcagctccccctgcccgtctccctggctcttcccataatactcaagggcaagagtgatgagataatccaatatctgttttattaaacacctagacatttctggcacatgtttcccaaatggggacctcaaaatctatactctccagctttaagactcctagcattcaatctacatttactctcccatgggtaggacagtcataatgctttcacataaaattgcagtatgaactgatggacaagaactctgggccaggagtcaggaggcccaggtcctcaccctggcccagcgactcataaagtcatgcaaccatgagcatcactgcctcctgggccaaagtgagcacaaaggtcctctctgtggtgaaatgcccttgcatttgtcttctaaggtaggagggcagacaccattgcctttggtctacaactgaggaaacaatatagggagtcaggtcacagcttcaaggtgacatggccaggcaagtggcagagccagacctgggtcttcacacactttcctcttcttgactgtactggcgcaggtgcttaagatttgggggaaggtgggtgggtatctggcctcttctttgggactcaaattgtgatatctctctgagaacccacaggctccctctttagggctgaggtgagaagttctgaaagtcaagcagacacatccaggcatttgggcaagaaacttcttccttccaaatcaaaggtgaaatgaaaacgattatgagcccacgggggatgaacagaggtgaatggtgggctagtctcgaggatggcctaattcagagtttcctaagtgtcagccattcatggaaccacccctgtgatttttgctacctctctggatctgtgcccacttttacgttatgtttttctttaaactgattcactatttttttttacagttagctttatcctagacagaacatctatcaaactacaggtcaatatgctaatcatatttttatattatacattaaatatataactaaatagaaaatattaatttgaataccatctaaaatcttcttgtgaaccagggatacacacatcagacattggcaaacagtagtacagatttaagtgtgagaaaacccaggcataagaaggaagaaggtaagttatttgctcaaagacaaaggctaaggtgagcaccagggtctctggacccttcagtagggtttttcataggtcactgaatgcatcctttggtgcacagaccagaaatgactgtgaatgcatccaagactcatctgtgaggctaccaagcggggggaaagatcagtcacttaccagccatgtacgtgaaattgcttgggaacctgaactcccgctggaatttctacctggaaagggttgctgatgctctatttttgttatccaacctcctgcccgctctggcccctaagaggcaccagggactatgttttatctcaccttagccaaaacctagtcttacaacactcctttccagtgggtaggggtgtgggggaatagccctgctggaggcttccaggctggctccgagatgcccacttctgcagaggaggccaaggttgcctgtgctcgaggcatgtggtaggcgtgaggttcctgctagcagggtgttcaagctgcagagggaggggctggagaaagacttcagtcctgtaactgtcaggtcgctgggccccggggctacaagaagaggtgagagcaactcttactcttgctgtatattcttggactcctactttggagccagcacttcttcaagggcttggttccccaggcattgttaactcccaaccccagtgactcatgagtgagcagggctcttagagccctagaagggtaattcaggcaaccttgggatattgtctctcctacaaaatcatcagagcagctaccatttgttcaatacctactgtgctgtcaggctgtgctaagtcccttagtgtcatctcatttcatccttatgacaacttaatgagttaggtgctaccattaccttcattttcagaggtgaagaaactgaggcactaagccatggagtccaagttcagtgatagtgggggttaaaactcaggtttgactgggcgcggtggctcacacttgtaatcccagcactttgggaggccgaggcgggtggatcgcctgaggtcaggagttcaaaaccagcctggccaacatggtgaaacccagactctactaaaaatacaaaaaattagccagggatcgtggtgggtgcctgtaatcccagctacttgagaggctgaggcaggagaatcgcttgaacccgggaggcagaggttgcagtgagccgagatcgcgctattgcactccagcctgggcaacgagagtgaaacatcatctcaaaaaaaaacaaaaaaaactcaggtttgtcttgactccaaaagctgcattcttttttttttttttttttttgaaacagaatcttgctctgtcacccaggctggagtgcaatggcgcgatctcggctcactgcaagctctgcctcccgggttcacgccattctcctgcctcagcctcccgagtagctgggaccacagggtccgcaccacgcccaactaatttttttttatatttttaatagagacggggtttcaccgtgttagccaggagggtctcgatctcctgacctggtgatctgccagtctcggcctcccaaagtgctgggattacaggcgtgagccaccgtgcccatcccaaaagctgcattcttagccaccactggggttggaaatgactaggagaccagagactactgctacctacttatctgtcacagagtactgagctcagggaatgaacctgttggcttggacttgggtctgtacctgcagcccccatggaaaagagggctcgcagcctctcctgggcggcctcatttcccagagcggctgactgctggtaacatctcaaggcctctcccagattcctctgcacaccaaggcctttctcatagcaaattccaaggtggtacctgctctgtgagtcctaaggagaaaatggacagacaaacagatacacacatgcaggaatgaggaactgacatgctaagggaggaggaagatgaagtcaggcatgctgggacttcatccacacacggtcaaggcccagtcctggcccgccccatagcaagggatctcaactacgaaatgccagaggctcagagctcacccaacacaaaggagagggggatccctccacccagggagattccagccagggcagtgtggaggcttctcttgcataggctggctgaaagcatgcacaacgaaggctacaggaaacactcaggccagttatagcaaacctgggagtcgggctcctatgttgccctgaaacagcaaggaggcgaaggtggagggttgtcttcccaaaggccctgtgccttcctgaatctctgcctgggagggctgacagaaaaggaaactcttctcctttaaaaagctatgcttggcctgggcgcggtggctcacacctgtaatcccagcactttgggagggcaaggtgggcagatcacgaggtcatgagttggagaccagtctgcccaacatagtgaaaccccgtctctaaaaatacaaaaaaaattaggcaggtgtggtggtgtgcacctgtaaccctaactactcagaaggctgaggcaggagaatcatgtgaacccgggaggcggaggttgcagtgcgctgagatcgcgccactgcactccagccagggcgacagtgtgagactccgtctcaaaaaaacaaaacaaaacaaaacaaaaaacgctatgctctttgccccagctctggatcctcgattgtctctcctctctctgagaactatgctcctgggaggaacaggatcaggtagaggctgggtgtccagctgcatagccagactgtctgcactcccatcacggctctaccacttaccagctgtgttaactcaggcacgtgactctacctcatggtgcctcagttttcttacctataaagtgggatgctaatagcacctaccttattaggttgttgcaaggattaaatacactatatgaaaagtgcttacattcactacatgaatcatattcactctcccaattaaaaaaacaaaacaaaacactattgactctcaaccatggtccaatttctcttctaccctccacagtcaaacttctgggaagagttgtctacacattctccccctgcttctataacacacaggccaaaagtctctccaacaaacatgacagactcatgcctacagaccacgttacaacacagcagtggacacacgtaaggccaaaacaccacccctgcaacactgctcagtacaaacccagaaagacacaattccctgtggggtggaagtgtgttgggtctgagtcccaatacagcgtcatatagcaggtgacagatatccttttgtacatttctcctgctagcacgctggtctgattaaagcaggccagcatgcccagtcttgccctgcacatggatgtgcagacctgcccaactttggaaggctctgtggggctctttcaaggcaaggcaggtacagcagtggatacctgttggtgacattggtccccttttgacagctactacagatactctgggcaacacagagtagacaaggaaaagcattctgatgcccaggagttcaacgaagctatcagtgtattggccagaaaacaaaggaagcagcagtcccctatgtagggagattacagttcacgcatatattgcttgatttaatccaagactcctggtccttcaagatgcaactcaaaagatatactggtcaaatacacttgaggaatacagcaaattacagatggccttttcagtgatctacagtgacataaagctttgagacttcctatattaactgtttaactcagtatttcccaaacccatctaaccatttttttcctcttatgacttacaagcatcccagagaactaatgcttcatggaacacatctgaattgtctgaatgccaatgaccccagttcacagacaaccagacatccccacccaccccaaactgagcagtgttccctgtttactgtctccacttgatgcgtcttctaatttccctgggttaccatcacttgtaatgatgtgtttttcatgtgtacaggtttcacagcactgtcacacctgttagttatctcagttagattttgatcctcacaaccaccctgtgaagtactggacaggtaaggcaagcattattattctgattttaaagacgaggaaacaggtttgaatcaagaagtgaccaggcccagtagtgtgctggtaaatgttgaacaactggctctcgaggagggaaaaagccctgttttatggcatttagcaatttctgtggtgcaaatattcccaccatagcagattttaagctgccaacagctctcacagcctggtgcaagccagctctggcgtactactgcaactgcccaacggtcacacagtaagtcagtgagcgctaaggcttgaagccaggccaaggctcctatccaacaatctcctaagcacagaagaactcagtaccagttccaaaatcccttctcttatcaggcttcatccccaacatgcttgtccactgagatcgcataccccattgttggctgcaagccaaagatatttcacagctctctgctcatccaggtagggctccttggtgaaaagcaccccgaggaaagcttgggcctgtggtcaaggaggaaggaaaagaaggcatcttggtcactttcaggctccacaggcctcagagaccttgaacagaccctgccaatggcactcacctctctcaagcctgagtctgcagcctgcttcagcaaggacactgccctctgccgctcagggttccacgaagaggctgggtctcgtagtaggcacctggcatagcggtactgagccaggctgtggccctggctggcagccaactgataataaaggaccgcctggggcaaagggagaaacacccagtcggctggcaactctgtaagcatcttttgcactcagtgaaatttttaaaaattattttaattaactaatacataataattatagactagtcagaaaattcagataagctaaaatttaaaaatataaaccaaaaatagaaacataaaatcccaagaaattcagcctcctaaagatcattcttgcttaaaattttagcgtacagccttgcaaatatcttctcacatatatgtgttagacatactcacacacataccttttagacatctacgcatttgcacgcacatatgtgtgggggggggcagagagagagagagacttagatcactctatactactttataacctatttttttaactttaatagtacaccatgaatgtctttccctgacatacagatctagcacatcattttaaggcccaaatagatgtaattaaccagttttccattgaagaaactttcaggtttttttgggtttttttgccttcacatacaactctacgaaatacattcttatatataacctctttgtgttcttatcccactttttaaaaattaattaatccattcatcaagatgctattctaggctgaggatgtagttgcaaagaagaaaggcaaaatccctgccctccctgaattttgagtctaaattcctggaagttaggagcttctttcttatttttccttcgcagctgggctagaaccaagtggagaaaagaagccaaactttcccccatccctgcccactgctcatttctagacatcaatctcagcagcccagcacagaaggcaggcttgggggcaggggaataccttgctaatgtccctgggggtgcctctgccatgctcatgacacaagcccgcattgtactgcgctttgctgtagccgcgggctgcagctttctggaagtaagaaaaggctgccgtgtggtcgccactcttcatgttctctgttcctgtaagaaggcacagggcacaaacacagcttcctcagtgaacttccccacaccctcagccaggtacctacagactcctcatctgatcctcctccctttctttttttgtgccagacactttacatatatatatatatatatatatattttttttttttttttttgagatggagtcttgctctgttgcccaggctggaatgcagtggcgcaatctcagctcactacaacctccacctcctgagttcaaacgattctcctgcctcagcctcccaagtagctgggtttacagatgcctgaccccatgcctggctaacttttgtatttttagtagagatggggtttcaccatgttggccaggcttgtctcaaactcttgatctcaggtgatccacctgcctcggcctcccaaagtgtcgggattacaggcgtgagccactgtgcctggcctttgcatatatttctatcttctaaatatttcactggtttgccatggacagcagtgggttctgccctactataaaccattcctccttctcttggtagtagcatctagatttcccattgggaacaacacctcccctagtgctgtcaatcaatgtgcttgtgttcttcctaaccacggaggttctttctcaggaatctgaaccttgatctggttgggacaaggagagaaaacagcccttgtaggtttattctgacagcagcactctgaagatactatcagctgctgcctcttaggtctctgaagcttccctgattcctgtcctttctgaggcttggcaggtcaatagatcccaatagattccttttatgtttaagttagccagagtgggtttaggttgctcataaccaacaaaccctaactgatacaagtgatactgttaatcttgtttcatgaagaaattgggagcggtaatacagcagtgtcaagacctgaatgcaggcacatccaaccccaaagtccatgctcttttcattgcccaaacaaaaaggaaacaggaaaggatgagggcacggccaattctcaactcaaggcctttgcttcaattgtctctcctgcctgggatctttctttccgcctccaccatcaaagctcccatcctgtgtctgctctaaaccttcggaccacactcaggcttaaacacttttttggcacttacttaatataccaagcctttttctacaaactaaaccgtttcaaaagtacaagtcctgtctcctcaattagactgtaaaatcctggaggcagaagcagaaaaagaatgtagaagaaataattttgcctagggtgaaggcgccatacaaatgcaaaacatgattatggcttatgctcctttcgcgttctgccaccatgccaagcgcttgctgaataaatgaatatatgaatgaagggatgggcaagtaaattctgagaagagactctttgcccatcaaaatcacataaagctcatgagggagaaaccaggttccattcagccagcagtgaattaaataaagttgcctccttgctgcctgaaaactcactgtccagggttgacagagccctctgcccttgggtagaagactcaagagtgcaaaggatcccaccatcctcctctttcccacctggctcattaatataaccagatccatctactcttcttgctctcttctttctctcatctagaccatgccactgacatgttttgttcagccgtcaccaacagcgcctgcctcgtctcctttttccccccggcaatcctacaatccatgtctgtctacatggcagccagagagatctttggaaaagtacatcagatcatgtggctgccccctttcctgctcctgcttaaagccctccaaagacttcctgtctcacttagaaaatccacactctttactgtggctcagaagacctcacctgatctgacccctgcctgcttttctggctttatctccttccgcccttcccaagatctctaagctccagccacactcacctttcttttgttcctctagcaatcaaaatccaatcctgcctcaggattttcgcgcttactgttcccgccacttggaaagctctttctccagattgaaacaaaagtggctgtctttgtgacaggtcttagatcaaaggtcttctgctcagtgaggacttctaaatcaaaaactgctccttgctcaagtcactaacacattcctttattttcttcataacatctatcaacatctgaaattctctttttgtttctcaattattgtttttctgctccctgagaataaggactttgtcttgtaaatcactgtatccccagtacctaaaacaggaactggcaaaaggtaaatgctcaacaaatttgttgtgaatgaatcccagcctcttgcctatctgcccactagaccccaatagatgctgtggggagtctgagtctccgcattagaaggcctaaaatgagccaagttactgcaaagaacagggcaaatggtggaagggtatttggagtccccacatgagggttaagaggttcctgttcacacatcgaggatctgctccaaaccccaggagcctgttctttcctaagtgtggcagagaatgctacgtgccctccaagattattttttccttcatacacagtaactagtctcctctgtggcgaggtgtggccatgtgcctatattctggacaaggatttgtgcaacgtctagattaaagggaaggagtgatcctttagcttccctaccttgccccgaccagctggctagaatacggacaggagggcaggagctggaattgccaaactgcgcctcaagatgggagccagttttaaaaatggcaggacacatctgcataagaatgggtccctgccatgccagatttggtctacctacctgggagaaaataaaatctctcgtttaagccactccctatcttgactatatctgagctaccccataccctttccattttcccaccctcctgccttggggcagggtccatttggttacccaggaagttgaaagcgatggaaacactgagctggaagagctgctgaatggaagtcacagcctcctcaagggaaagagtttttgatttatcttgttcctgggaaagaaatataaaagactcaccaagggatggtttaccaggattgccacctgcccaagagaatgttatggggatccaggtggccaaatctggataataccttttcaccagtgggctgaggctgggctggttttgcctcggactcgatgctactactggcatgcaggaagccaaaatcaccgggacctgcaagggaaaggccgacacccggccagggcaaaggagaaagttgtacttcttttctccgactctcccagtctacccaggctttccagccagcacccttgccaggaaccgaaataaccctgaatcacctcacaaggcatgggacctcacaggagtgccaattcccttcgcagcaaacaacgtccatcttgcccagctcaccaccaccgccccctgccttctgctgattccatgaggcagggacataccttcctcagaggggtcctgaggacgagctcctctcaaagagttgtgtgagaagttccggggctgagctgaggcttcttcctggccaagcctgggttccctgaggccagtgtgcctgggagctgggccatcggggctggggaggatgtgttgtcgcagtgctggaaagagccagcaagagtagtcaggtctgggccaggcgcgatggctcacacctataatcacagcaccttgggaggccgaggcgggtggatcacctgaggtcaggagttcaagaccagcctggccaacatggtgaaaccccatctgtactaaaaatacaaaaaattagcggggtgcagtggcacatgcctgtaatcccagctactcaggaggctgaggcaggaaaattgcttgaacccaggaggcggaggttgcagtgagccaagatcacaccactgcactccagcctgggtgacagagcaagactgtgtctcaaaagaaaaaaaaagagtgatcaggtcagaagaggatcagtgcaggctgctcgggcttgactgagtcctccctgaggttttagaggccataggaagaattttgaaactcctgtgacacttccttcacactcctcctcctctgtttccttggcttccctccagaggagtctagaggggcctgtatttgtgctgatctcccaccctaagcatcaatcactcctctgcctaaattcttcagtggcagggaggcatctaccttactcactgttgtagccccagtacctagcactttctttgatagcaatattgctaatgattatcatcataataaggacaagaactaatgcttaaactaataattactacacacttactatgtgtcaggcactgccctaagtccttgacatgtattaactcatttagtcctcccaagaaacctatggggtgggttttattattaccccaatttatagataaagaaaccgaggcagaaggaagttaaaagtgacttgttcagggacataagactagtatgcagcaattttgggacttgaacctctataatctgactccagagcctcaaccactaggctatgttgcttctgcaccatggcacataataggtgctcaataaagattcatttatttatgaatgactgagtgactgaccagagaataatttaactggttgaatgtgggccaggaagccacacccagaatctaaagtagtctggaccctgtgggcctcccttggttggaggtgatgggaggaaatggaaagacactgaggggcaggtgtggcccatgccctgggtggatagaacttccccacattcctcttcctctgacttcagataggaaaggcaaggagctgctgatggctcttttcctgaggtgtgtccagagacgcttcctggcccagagaaacgcccagcccagccctcctgtccccaggactgagaactcacaggagcatgggtgccacaagggagatgagaagaaacggtccaggggactgtgccaggagcagtgttctacccgctgaggtcctgctggcagggatgcctggaagtggatctgccttgccagctgcagggccagcacggccagagtgccctgggaaagacagcacgttaaggacacggtccttcaccaatcaactccatcagacccggccttattctcaaacatcacttcctcaggaaatccaggtggggcagctccccgactacaaactttcacaacaccctaacttctctggagccctgaccacactggcatttaaacaatcatctctacatttatttatctaaggtctgtctctcctgttagtctataagcacgacatgggcagggaccatgtgtgttttactcaccaatgtatctctggtgcccaagtacagcacagtgctaatatatagtagggacctaataagtacaacctgaataaatgcttgatcaagtgactaaataagcgaagactaagcaggcaaaaagataatggggtaggttggcacctagttgcaaatatagcaacaggtcagagttccccattaggctctctttccagtcttgcacaacccctccttccaccaactcccattcccccagtgaagccaccccagcacacacacatctccaggtgtaagctttgtaaaggtgtttcttctctgacaggtctgcagaagacctgagctagctcttatcccagagactccttggttttccctgtctcctgtctctccttatgttatgcttaagaaggttgacccagggtcgggtgcagtggctcatgcctgtaatcccagcacttgggaggctgaggcaggtggatcacttgaggccaggagttgaagaccagccaacatggagaaactctgttccactaaaaatacaagaattagccaggcgtggtggggcacacctgtaatcccaactactcggaggttgaggcatgaaaattgcttgaacctgggaggcagaggttgcagtgagccaggatcgcaccactgcgctccagcctaaaaaaaacacacaggttgacccagatacttacttgttgctccaggcactgcatacaatagcaagtaagacagacataatttctgccctcatgaagtttatatcttgtgtttagaaagacaaaacacaactacagagagaaatagagtaattactagtgatgttaaatgccaagaaggaaactaatcagagagttacacagagcataaaaggggtcctgacaagacaaggagtcagggaaagcctgtctgtgggggtgacgtgtgggctaaggccagaagaaaaggcaccagcattgtgaagaacagagacaagtatccatggtactgaggacagcttgcgtgcagaccctttcatatgagcagtagtgacagagcacagggatggcattgggacttctggaatccaggcccacttcctacttctcactatgggacagccctagggctcagatcttctttggcaacatgggaaaatgctcctctcttcagggtatgatatggccttagtccacagctccccatagaggggtaaccctgtcatggagacatcccaggctcagctctgctgatgacaccaatttacagatgagaaagccaagggtcacacaggtcaagtcatttgtccaaagtacacagcacgaaagcagcagggatgagctgtgacaaacatgagagtgatgtgtgtgtcaacttcattcagaagatcttataagcagaacttccacctggaacattgcctgaaaagcgaagactctgccctatgagacctagtgttcactagtaagaatctgaccttatagatcaggttcaacaaatatttttgagcaactattacgggctaggctctgtatttgatgcagcaaccaagcagtagaacatgaactccagagttaaatctggctcctccacttaacaggtatgagaccctacgcatgttacctaatatttcagagcctgagattcctcagctgtaaaatgaaggtgatatttcccttgtaagatttttgtaaggattacacaagataatgcatgtataatactttacattaataaataatgctataaggccgggcgcggtggctcacagctgtaatcccagcactttgggaggccgcggtgggtgggtcacgagatcaggagttcgagaccatcctggccaaaatggtgaaaccccgtctctactaaaaacacaaaaattatccaggcgtggtggcacgtgcctgtaatcccagctacttgggaggctgaagcaggagaattgcttgaacccgggagacggaggttgcagtgagccaagatcatgccgctgcacttcagcctgggcgacagagaaagactctgtctcagaaaaaaataataatttaaaaataaaaaaaatgaataataaaaaaaagatgcaatgtattattatttattgtaagatccatgaaggcaagaatgtatctatcttgttctctgctatgtccgtagtgactagcaaaaatgcctggcccagacaaggtgttacataaatgtttactgaattaaatgaggaaaacatacatggcgggggtgtggaaagtggcaatatctccttgaatatgctccaataccatgggttacttgttaaatggacacagtgattccctagcccttgttccaggttcggctgtatacccatgaaggatcattctcatctacactgaaggtcaaggaccaggctggggaagccttacccaagatatggcatcccatagggtgttcggggagacacgggaagacatccattggaaggcatccttccatccatgggaccttggacccccgctcgtgcctgggccatggggacctgacctagatgatgaaataagaggctatcaagtaggggcaaagggagaccagggactgggtgcggtggctcacacctgtaatcccaacaatttgggaggctgaggtgggtggatcacgaggtcaggagttcaagaccagcctggtcaagatggtgaaaccccatctctactaaaaatataaaaattggctgggtacagtggctcacactgtaatcccagcactttgggaggctgaggcgggcagatcatgagatcaggagatcaagaccatcctggctaacatggtgaaaccccgtctctactaaaaatacaaaaaaaattagccaggcgtgatggtgcatgcctgaaatcccagctacttgggaggctgaggcagcagaatcgcttgaacccaggaggcggaggtttcagtgagccaagatcgcgccactgcactccagcctgggcgacagagcgagactctgtctcaaaaaaaataaaataaaataaaaattagcagggtgtggtgacgggtgcctgtaatcccagctactcgggaggctgaggcagagaactgcttgaacctgggaggcggaggttgcagtgagctgagattgccccactgcactccagcctgggcgacagaatgagactccatctcaaaaaacaacaaaaaaaaaaaaataaaaaaaaagggtgactaggggaggaaatgagtggtaaaatggcagtatcttacctgtcgaggttaggcacaggaaccagcaaagtggaggaggtagtctgaggcccatctgggctggtggacttaggagtcaccctccagaggctaggtcccagtgtacggggaagagctgtacagaacaaccaaaactcaggcacctcaacaagaacccaggaatcactgtcatctgcctcagcagaggttcttaaacatggatacacatgggaatcttttatctactacagattctagggtagtaccccagaaccaataaactaagatttctcagggtagagcatccacgttttttaaaagcgcccatgtgattctgctggtctcctgtggatgccaaccactgttctaagatgaccaaacgttcatacatatactctcactaatgtttggggctctttgactctaaacctctcctctcttcactggctatgcctactccattggcccctaatcctctttcattcattcagtccaccatctcctgccattggactcctccccctcccaacagtcctaccaacttcttggactccaccctcttctagctaggcccatccacatctcaaattccagcagcccctgacttccccgccctctttcaagccccgccttccttggctctaacccggcccacgatcgcttcggctgtttcctcgggcccgcccccactccagttcggtctttgcggcccagagtgacgctggttgcttggacgtcccttacctcggcccaggagtcccgggaggcgccacatgtcgctgccagcaccacagagagctcgcagccgaaagcgcgagaccaacccttgggacagcggctagaaaggccgccgcgatgccccgagtggccgagtacccgaggaagc

SEQ ID NO: 13261 - DNA, 13237 bp, Homo sapiens
agcaactgtttggcagtcagagtcccacatcctgctcaactgggtcaggtccctcttagaccagctcttgtccatcatttgctgaagtggaccaactagttccccagtagggggtctcccctggcaattcttgatcggcgtttggacatctcagatcgcttccaatgaagatggccttgccttggggtcctgcttgtttcataatcatctaactatgggacaaggttgtgccggcagctctgggggaaggagcacggggctgatcaagccatccaggaaacactggaggacttgtccagccttgaaagaactctagtggtttctgaatctagcccacttggcggtaagcatgatgcaacttctgcaacttctgctggggcttttggggccaggtggctacttatttcttttaggggattgtcaggaggtgaccactctcacggtgaaataccaagtgtcagaggaagtgccatctggtacagtgatcgggaagctgtcccaggaactgggccgggaggagaggcggaggcaagctggggctgccttccaggtgttgcagctgcctcaggcgctccccattcaggtggactctgaggaaggcttgctcagcacaggcaggcggctggatcgagagcagctgtgccgacagtgggatccctgcctggtttcctttgatgtgcttgccacaggggatttggctctgatccatgtggagatccaagtgctggacatcaatgaccaccagccacggtttcccaaaggcgagcaggagctggaaatctctgagagcgcctctctgcgaacccggatccccctggacagagctcttgacccagacacaggccctaacaccctgcacacctacactctgtctcccagtgagcactttgccttggatgtcattgtgggccctgatgagaccaaacatgcagaactcatagtggtgaaggagctggacagggaaatccattcattttttgatctggtgttaactgcctatgacaatgggaacccccccaagtcaggtaccagcttggtcaaggtcaacgtcttggactccaatgacaatagccctgcgtttgctgagagttcactggcactggaaatccaagaagatgctgcacctggtacgcttctcataaaactgaccgccacagaccctgaccaaggccccaatggggaggtggagttcttcctcagtaagcacatgcctccagaggtgctggacaccttcagtattgatgccaagacaggccaggtcattctgcgtcgacctctagactatgaaaagaaccctgcctacgaggtggatgttcaggcaagggacctgggtcccaatcctatcccagcccattgcaaagttctcatcaaggttctggatgtcaatgacaacatcccaagcatccacgtcacatgggcctcccagccatcactggtgtcagaagctcttcccaaggacagttttattgctcttgtcatggcagatgacttggattcaggacacaatggtttggtccactgctggctgagccaagagctgggccacttcaggctgaaaagaactaatggcaacacatacatgttgctaaccaatgccacactggacagagagcagtggcccaaatataccctcactctgttagcccaagaccaaggactccagcccttatcagccaagaaacagctcagcattcagatcagtgacatcaacgacaatgcacctgtgtttgagaaaagcaggtatgaagtctccacgcgggaaaacaacttaccctctcttcacctcattaccatcaaggctcatgatgcagacttgggcattaatggaaaagtctcataccgcatccaggactccccagttgctcacttagtagctattgactccaacacaggagaggtcactgctcagaggtcactgaactatgaagagatggccggctttgagttccaggtgatcgcagaggacagcgggcaacccatgcttgcatccagtgtctctgtgtgggtcagcctcttggatgccaatgataatgccccagaggtggtccagcctgtgctcagcgatggaaaagccagcctctccgtgcttgtgaatgcctccacaggccacctgctggtgcccatcgagactcccaatggcttgggcccagcgggcactgacacacctccactggccactcacagctcccggccattccttttgacaaccattgtggcaagagatgcagactcgggggcaaatggagagcccctctacagcatccgcagtggaaatgaagcccacctcttcatcctcaaccctcatacggggcagctgttcgtcaatgtcaccaatgccagcagcctcattgggagtgagtgggagctggagatagtagtagaggaccagggaagcccccccttacagacccgagccctgttgagggtcatgtttgtcaccagtgtggaccacctgagggactcagcccgcaagcctggggccttgagcatgtcgatgctgacggtgatctgcctggctgtactgttgggcatcttcgggttgatcctggctttgttcatgtccatctgccggacagaaaagaaggacaacagggcctacaactgtcgggaggccgagtccacctaccgccagcagcccaagaggccccagaaacacattcagaaggcagacatccacctcgtgcctgtgctcaggggtcaggcaggtgagccttgtgaagtcgggcagtcccacaaagatgtggacaaggaggcgatgatggaagcaggctgggacccctgcctgcaggcccccttccacctcaccccgaccctgtacaggacgctgcgtaatcaaggcaaccagggagcaccggcggagagccgagaggtgctgcaagacacggtcaacctccttttcaaccatcccaggcagaggaatgcctcccgggagaacctgaaccttcccgagccccagcctgccacaggccagccacgttccaggcctctgaaggttgcaggcagccccacagggaggctggctggagaccagggcagtgaggaagccccacagaggccaccagcctcctctgcaaccctgagacggcagcgacatctcaatggcaaagtgtcccctgagaaagaatcagggccccgtcagatcctgcggagcctggtccggctgtctgtggctgccttcgccgagcggaaccccgtggaggagctcactgtggattctcctcctgttcaggtacctggggcatgggcagctctttctctggtcactcctggaccaccagaaacagaatcagacacccccataacctgcacagtcctcatgtttcttccttaggctcacctggcactttctgatgctttgggtagcaatggttcagggcacagctttgtgatcggctgaacttagctgtgtgatcctaggcaaattccttactgtctctgggccttagttgtcttatctgtaaattagagatgatagtaagagtatctaccttgtagagttgtccagaggatttgatcaattaattcctataaggcatttatggtgcctcacaagtagacacacagcaaaggtagtgattaagagtataagctttgggcaaggttacctgggttcaaatcctggctccacttcttcctagctctgaaccacagaggaagttaacatctctgttgaagatgtctatgttaacaccacccatcttctaagtttgcttgaaaataaaatgagtgaatgctcttaatgcctgtagaacagtgtccatctgacatgtagtcagtactcagcaaattattactattacttcctcaaagcacttctccatctccactatttgcctgccttcatctcatctgggcaacttccctatgaagaaggccagcataggcatcattgcacccaaacccaggtgttgcaaataatttgtctgagaccccagagctttccggctgggcctgcggatggggcagtggaaattaccttagaacttagcagttaggcagattggagttcagatttcaacacagccacttaggagctgggcaaccttgtacacgtccttcaacatctgagcctcattttcctcatctataaaatggggattatgagaccaaacttaccctgtgtctgcctccttagagtgtgagggctaaatgggatgatgagtgtcaaaatgtctaaggacctgggattttctagacacaagtggggaaacctttccagggatgatgcctgatctcacacccatatctgcttctgtgaacctcagatattttcactgtgccaggctgcccgcccaaggcacacttctgtttggccaggctatcagctcaggtttcctgtgaagcaaaacacagtttccttccctattccctcctcaggaagccacctggagatggcccagctgttctcttaggaatcttgccctgggatcggtgcagacccagaggctgccagagccaaccattcatttatccttccattcatccatccatttatcaggtgctttttggataaactctgtgctgaacactgtgctggctgctggtagacaggacaacagagaataggccctgtgggtgaccccgctgaggtgacagaaagaaaggtgcccatttgggatcaacttgagggtaacaggcaacttgcccaatgctcatatctttccagcagcacatagagtcagatctgagtgtaaattccagccctcccactaatttctgtgtagcccctgtgagcctccaattccacctctgcaaaatggccataatggtatctcttcccttaggctgttgtaagaattaaatgagattatacaccactggacaatcactgtttatcatgggatttattaataagctcatttaaacctcgtaacccaccatatgacctgggtctcattaatatgcactttttttactgttgaggaaactgagtaattttctcagaatgcttaagtaattcctcaaggccacactgatgggaactggggcagggacatatttaggatttgaacctgagtctgactgattcgagtctgggctgtaactgtgaagtgaccctgaatgacagtgctcagcatagggcttggcatgtagggagtcatgtcatgaaaaggcagctgtcacttgagcaaagggtggcaggtatcttaggagggcttctgggcctgggctgggaggtgggatcttccctgaggcaggcaataagaccccgagtctcccaagtcacagtgaaaccccagtcctggccatctcctcttccaactctcctctgaggttgacacttcctacctcaagctgcacagaggggcatggtggacctcctaagggaggaatggggatggacccaggaggaggaagcagtgtttctaggaataacagtgcaaactccttgcttttgcagaggatttttaactttttcaaaccatttaatcgtgacaacactgagaagaaggcgtgtgggtatttctagccccctattagagatgaggaaactgaggtctgaggaggtctaaaaacctgtctaatgctatacaataagctacaaatggccttgaactagaactccgcctcccaggacttgatctgttgcctctcccttccaatggcctatagggtctggccgtgatatctcacccatcccctactccattctccagtctttctgaaactctaccttctcttccagcctttcagtgtgcagtgcttctgcctgaaaacctccccaccccttgcccagaccttcattctctttccacttgccaaactcctatggagcctttgggtctcagcagaggtgcctggcatgtggtatgaactcagtaacatctgttgaaatgaatgaattaacttaatccagtaccacccccctgcttcctccctgctccaagttgggttaggggccctctgctcccacagagcccccattctttccctatgcccagaggcaacccctgtggtaaacactcttcgctgccctgatctccagccagcctccctgtggggctgcctgcaaccttcacatcctgacagatgtgaccacgctgagggcagcagctggggctccttctccttcttactcccatagcaaccaccctgcctggcacttattaagtacttgttgaatgaatgaaaagatgaataaatgaataattcaatgacaccattttgccttctctacaacatagtcttacatctggtcaacaaaaattggccgaatgtccaaatactgctaaaggggaacataactctttaagataatcttcatcaaagtaacaacaaattgatggtcaggaaatgcctttttcaccccatctctcagagtccaccaggtgcaggacactcggaggaatgagtatgaggggacaggcccagagggtcctcttgctctccttcagacactcaggtcctggggtgacatgacagagcaggggacctgcccgcccaggtccctgtctctgtcactgggcaccatcccccatctgatcacacaaacatctgaagccagaggaaagactataaaaagaaagcaccggcattgagggaaacatccggcgaggaagtgtgctgagtcggaattgtgtggagtcaacagatttttcctgtcttgtagcaaatctcccagctgctgtccttgctgcatcagggccaattccagcccaaaccaaaccaccgaggaaataagtacttggccaagccaggaggcagcaggtaagcagcacgtagcccccacaggcatctcaaggcccctactggccgcccctcatcactgcagcctctgtgagtgaggaagggtgagcacaagtcagacaccggtcccctgggagggtgcagcagacagcatccatcctcccaccctgggagttttggtcgtgaggtgactgtattgatagtatttacaggacctagaagtcctgtaggactaactagctgtattgataaataccatcaatacagtagtcaccaaggaaatgacctcatccctgagactgtatttgtcccaattacagaggtgctgtaaattgcctttatatctgtaactgtcacctctctttctcttgacccataaacataatatgaaggctccccactaaagacatggctgtgtgggcgtgtccctttgggcaatcctagaattgaagacaccttaagagaacatcaaatccaacttcttgttacggatggagaaactgaggctctgagtagcttgattcaaaccagctatgtaaacttgagcaagtgagataatctctcaggaccttggtttccccatctgtaaaacagaacccatcccatttcccttgtggtaatggggtgaggatttcataatcaattgtattctaagcccatagcccagcaactgacacatagtaggtgcacacacaatgctaactcctttccccttgaagcaattttgctaaaggtcatgtaacaagtgagtggcaaagctgggaccagctctcagagttcctgactcctgcatcagtgctcttgccctgacaacttacagcttctttttacaaggatggtgagaggtagtgtactgcaggggtgagtccacacactccagggtcacactggcctggatttgaagtcttgctttatctcttaatctatggggaccttgggcaacctgcaaaatcttcacaagtcttggttttctcatttgtacaatgggttgattaaagagaaccccttacaggtgtggaaggtttgaataagacggtgcatggaccttgcatcgcataaggcctgactcagactcactgctcaaaaacattagttgtcattatcacccacacacttgccacctccctgctcatttcttcacagcagcagaaatggctacaggggaacaaaaccaaacaaacagaaggactcctacgccttaaaacccctcaggtagccttcccacctgctgggatgagggtccaggcctgtccccaagtgtctatgggagagagggaccaggatggagacagcaggagactggggtgcaggtagcagattctgagcagctttaggctgcctcactccggctgcaccctccataggtctgctcttctggcctaggatttggcctaaagtagggaggaaggaatgttcagtcactcattcagcacccactgtgtgccacgccctgttctgagcatcagtaagggagcaggcaatgagacaggcaaaaatcccagccttctcctacggacggatggacggctgcactggctccactgaggtttactaaactcctcctgtgtgccaggcaatacctagacatgggaggggcaacgagaatgatatcaatgaactcatcttcacttctgtctgctgagtgcttacaatgtgccaggctctgtggtaggcccctctacctacaacgtctcattttaccctcacaacaccctgtgaggtgggtgttatttattactctcattttacaaatgaggaaacagagtaagaggagggcgggaatcacatgatccaggttggtctgactctagaggccaggctgtgtatccagttccctatatgggtaaatgaatgcaaacatgaatgggcatgaatgaatgaatctatatgggaatgtccctacccatggactggttggtttcttttgcaggagtgcaatcccagacacagatggcccaagtgcaagggctggaggccagacagacccagaacaggaggaagggcctttggatcctgaagaggacctctctgtgaagcaactgctagaagaagagctgtcaagtctgctggaccccagcacaggtagggaccccctggagttaccttgaccctgcttctgccccatggtgtccaagcttcagagttctgctccaatccactgcagggaaaagccattctgtttctgtggaggaacatcagcaacatttaacttcccttgcacccttgcagcctcagaaagtattttaaagaccaggttctactttgattttttttttttttagacagggtcttgctctgtcacccaggctggagtacagtggcatgatcacagcatgatcacagctcactgcagcattgacctcctgggctcaggtgatcctcccaccttagcctcccaagtagctgggactacaggtgagcaccaccaccacatcccgctaatttttgatttttttttttttttgtagggacagggattcacctgttgcccaggctggtctccaactcctgggctcaagcaatccacccacctcagcctcccaaagtgctggcattagaggcatgagccacctgtaatcaaagccaaagtaggcacctggcctacgttgattattcattttaaaaatcattgtaaaaatagtgaacatgccaggcactggggaagcatcttatgtacatgatctcatttaagcctccaaccaatcccctcaagtagataattattacctcgaatttacagatgagcaaaccgaggctcaaaaaaatcaagtagccttcccagagtcacccagctcaccagtgattgaaggggagccaaaccctgagccagcctgtcctctatggacttcttaccactcattggcgtttggtgtgtttcaataccctttcaccctgggaaccaggtcaactctttaatatgctaacaattgcaatgaaaacaaaaagatttttttgcagagaaataattagctttgacaataaatacataatgtgaacttgaattcaagaatctgctagcgccccccgcccctgctgtggacattggtcagcctcctttggtaacacaccccacggcagaccatccctgtgctgtggttttctatctatgtagttaacactgtttctcatgtgctccatctggctgcagacacactgaaggtatggcagggacttctctttccttggttaaaaaatattgctaatgtttattgggcactttctatgtgctaggccctgttctaagtacctcatgagaaaatcttatgagataggggctattcattatccccatttcataaaggaaaaatgtgagggtcaggggtgtttcataatttgcccaaggttgtgcagctcgtggatggttattaacacaggcagtgtggctgtaaattttagagctgtgttgttcaatgaggtagtcactagcgacaagtggctatttaaatttaagtgaattaaaattaaataaaataaaatattcagttctgccataccagccacatttcaagtgctcactggctatgtatggctgggggatatagctttggattctatctctattggtcagctctggctggaacctgtggggtcagttcccacacggtcctgcttgcccacagcacaaagggtactgaacacaggggcactgtaaggagttgggggtaaggaaagaggaggggcagaaaagcctttgctgctcacaggctggactgccatggggagactgggatcttgctgcttcagatctgcttcagattgcttcagatttgctgcttcggattcagattgccccacttgagaatgcgaccatgataatgttttcctggttgcatgaactcactgaacctcacaacaactccacaagatacgtactactgtctcaccacttcctaagaggaaacgggagcttagagaggttaagccattttcccaaggtcacacacactgcccctaagctgcaaagctgggaaatcaaacccaggttggcccagtgcccacctgcagctagaactggtgggtgatgctgggtgaattcagcatcacttttcagctgttctcatacgccccagtgattttctcattccaagcttcactccttctgaagctctctgacccatgtaaaaggaaaggcctgattctataacaccaagagttccatccaaccttatagcctcagagtctcaaggaactaaggtttgcatttcccaaatgttgaaggttaatatttatgttcattcaatcattcaacaaacattcactaagtcccaggcatggggctaaacccaaggatccagtagggcaggagcccaacagtgtctcacaagctgcacagtccagaatgcagggcagagattcatttatcagtacaataaatgactacacatacttcggaataacttgttcaaattacataagtaatatttggttaatatagaaaaacatagataaacaaaaagagaatggattgcttctgcccagaggtaatttcagttaacattttgacatatctccttccagtctttcattctgtgcgcagattttaaagtaactcaccttaggcaaacattagataaatgttaagtagatgttgtgcttttttttttttttttaatttttttaagacactgtttcttaactccaagacttataatttctttcctctggcttggtctctaccatcaggcctgggactggtttcttgaaacaggattttctgttaaagggatgggaaaagaagggtgactgtggcattgcaaatgtaggggccagttttttgaattcccagccaccaggctgacttgccaccgccactaccccagtccctctcctgggacagcccttggacaggcagcccctccccagcctgactctaggccagggttccagcagcttgagagatgatgttgaggaggatttgaggatctggggccaggtggtaacagtgcagaccttaggtagcctgggaattccagaggccccagctgggcacctggagtatccagggggaggaagggccagctcttcagagagagggtagggtggtgccatcataggcttcaaagtcatcagacctggcatcaaattgaggtttggttgcctagcagatgtgtgacttaacttctttcagcttcagtttcctcatccatcaaatgggaataatactcttgacctcaaaggtttgtgaagttaaatgaaataattatgtaaattgctcatcacgtaagtacctaatatgtggtccctattattatggatgggaaccaaaaaaggcagcgctaagtcaggaactccagccttggcaaagaaaagggattttccctccatcctcagctagtggagccctgaggggagaaggcgccctgaggggtaaaaatcctggatgaaatatagaagacactgagactggaaacacacgcccagattgggaaattcttcagaaatcggcaaatttctacttctaggccttctcctcctcctgctgcttccccacttggttcgcccgggtgtgtcagtcgactgctttcctacccagggagcttccctgtcagggcctcttccttcctgtccccgtctggccactctgtctgtcccctgccatttcccttccctcctttgtccactgcccttgccctgctcattgccccaccctcacccgcctggcccttcccggagcctggccctcactgtgtcccctccttcccccacaggtctggccctggaccggctgagcgcccctgacccggcctggatggcgagactctctttgcccctcaccaccaactaccgtgacaatgtgatctccccggatgctgcagccacggaggagccaaggaccttccagacgttcggcaaggcagaggcaccagagctgagcccaacaggcacgaggctggccagcacctttgtctcggagatgagctcactgctggagatgctgctggaacagcgctccagcatgcccgtggaggccgcctccgaggcgctgcggcggctctcggtctgcgggaggaccctcagtttagacttggccaccagtgcagcctcaggcatgaaagtgcaaggggacccaggtggaaagacggggactgagggcaagagcagaggcagcagcagcagcagcaggtgcctgtgaacatacctcagacgcctctggatccaagaaccaggggcctgaggatctgtggacaagagctggtttctaaaatcttgtaactcactagctagcggcggcctgagaactttagggtgactgatgctacccccacagaggaggcaagagccccaggactaacagctgactgaccaaagcagccccttgtaagcagctctgagtcttttggaggacagggacggtttgtggctgagataagtgtttcctggcaaaacatatgtggagcacaaagggtcagtcctctggcagaacagatgccacggagtatcacaggcaggaaagggtggccttcttgggtagcaggagtcagggggctgtaccctgggggtgccaggaaatgctctctgacctatcaataaaggaaaagcagtgattcat

SEQ ID NO: 13262 - DNA, 173 bp, Homo sapiens
ccagcactctgggaggccgaggcgggcggatcacctgaggtcaggagtttgagaccagcctggccaacatggtgaaaccctgtctctactaaaaatacaaaaatcagttgcgcgtggtggtgggcgcctgtaatcctagctactctggaggctgaggcaggagaattgcttga

SEQ ID NO: 13263 - DNA, 1235 bp, Homo sapiens
ttttttttttttgacagttaatgccctctgggatcatactgaggaaatttaaaaaatacccacaccagatggtttacaaaggaaaacatttaatcatggcagatcagctcataaaaattattgcctgcaaatgtatatacaaatttgtcaaatattctcaatgtaaatttactgaatttcaaagagaggtaattcttttaaagggagtactctaaatatatttaatatgattttctgccactgattgaatcaggcagccaaacagcaagaagcacaactgaaatgggttcttcttccaggtaaacactgctgacccttcacaagagggcttccccaatttggctatacctcagaatcatagaagcagtttatttcaagaagtactgattctaagggaaaaggataaaaagatataatgagcaaaaactagtcagaacagagagcagatctaggggatcaacataaaaatttctaaaggataagaaaaagagtgaaaaaatattagggaaagaaaaaaaaattccatagaagtaaaattcccagagttgaaaaaagacttgcatctatgcactaaaatgtctcatctagtaccatgcaaaaataataaaaagagatctatttttaaaaacatatcccaatgaaatttctttgttccaagaagaaagaataaagaatctataaacatcattgtgggaagataacccaaaggtacctacaaaagaagcgcaaagagtttggacttctcttgggcaacattaagttgatgtgataactttctgtgactttagtattctgagggaaaagtcactgtgggaaaaaaatgttacgctctattgaacacaagtatcttcaggaaggcaagaacatataatactgtatcacccatctgttccttaaaaaagtactaaaagaagtaccaaagacaactgtgaaatgagttgaaataatggggatatacagtgcaaatgaaataaaagtgatcaatgaaatcagttaagcaggtgtaaatgtctaaatgcttgtttaaaagcttatgaaacttaactcaaacatcaaaagccttcttgaaacagaagatacataatgttaaaaagtaacaataatgtagatctaaaatctcagatcatttcaacagtagttgggaagattgaaggaagaagtaaaagcatgataaatttcattctcaagaatgatttcacgtgtgtgtgtgtgtgtgaattagattattaaatgtg

SEQ ID NO: 13264 - DNA, 660 bp, Homo sapiens
ttgtgaagaatgaaagaacaaagcttccagagggtggaaggggaccctggcagcttgcccctgctggctggggtggccagcttttattcccttatttgtccctgcccacatcctgctgattggtccattttacagagtgcttgattggtccattttacagagtgctaattggtccattttacagagtgctgattggtgcatttacaatcctttagctagacacagagcactgattggtgcgtttttacagagtgctgattgtgcatttacaatcctttagctagacacagagtgctgattggtgcatttacaatcctttacctagacccagagcgctgattggtgtgtttttacagagtgctgattggtgcgtttacaatctctagctagacagaaatgttctccgagtccctacttgacccaggaagtccagctggcttcacctctcagtatcactgaaccaatgtcttctggtcacaggtttcctttttgtaggtgtcctcactgtaagtttgatacaggacaacctaactgctcaactctatttcatggtaatgccagagttattagggctttattaggggcatcaccacatctagagtaaaatgctccatttctacaaatattttacaaatattcctttgtaatttaatagataaa

SEQ ID NO: 13265 - DNA, 271 bp, Homo sapiens
tttttttgagacggagcctcgctctgtcgcccaggctggagcacagtggcgcgatctcgactcactgcaggctccacctcccgggttcatgccattctcctgcctcagcctcccgagtagctgggactacaggcgcccgccaccatgcccggctaattttttgtatttttggtagagacagggtttcaccatgttagccacgatggtcttgatctcttgacctcgtgatccgcctgtctcggcctcccaaagtgctgggattacaggcatg

SEQ ID NO: 13266 - DNA, 7315 bp, Homo sapiens
ttggagaaggtcccggacctcatcagccaggtgttggccacctaccctgcggatggggaaatggcagaagccagctgcggagtcttctggctgctgtccctgctgggtgagctgggtgggcgccctgggcccctggggctgggaggggtgggcctcatggcacagcaggcacaaggcagcccggcccctttctgcaggctgcatcaaggagcagcagtttgaacaagtggtggcgctgctcctgcaaagcatccggctgtgccaggacagagccctgctggtgaacaatgcctaccggggactggccagcctggtgaaggtgtcaggtgagcctggggacaggacgaggctgccacctagaggtgggggcaagaatcagcccccatcagttacatctgccaggtgccacaaaccaaaaaacagaagcaacaaatcaaaaaggaaaagaaattaaaaacgatctgaagtccagtcatccagaaatcaccatcaagactttcacgcacacttgataaactcttgtctctgcgttatgctaccctgtgaccctctctctgtccataaacacatcacatctgcacaggtttcctaacatgcaggcacaccgtgactgatcaaaacagctctgcaaacagtgtctccaattccccacaacacaaaccctgcctgttactcagctagacaggctgggcccagcgctgagcacagcacaaccgacgctcggcccacagcacagtccttcagagagcatcctgggcctggccaagacactagctggtgcctggcaactccgggctcatggtcttgacctctgtactacctaatcttccccagagtgacaacgacccctttggctctgggggggctgcctcctctgttcttgcatggtcctgttcaggtcatgccagcctactggtccgcccaagctgatggggcctcctgggtcccgtctcttgtcctgtcccaggcccctgtgtgagctctggggtcccatcccgtcctgggcagaaggctcttccctttcaggggaaagcagggaatgaacccactcccacccatcccccagagctggcggccttcaaggtggtggtgcaggaggagggcggcagtggcctcagcctcatcaaggagacctaccagctccacagggacgacccggaggtggtggagaacgtgggcatgctgctggtccacctggcttcctatggtgagaaccccttctcacctcacactccctagagcccagcggtcaggggtgccccgctccccctataactgacagggaaggagcacatggaaggtgggctcaaccccacttctcggcccacttaaacttcccactcatttggcatcttctgagcaccaggggttgtcctggctgagggtgacgcttggggctccggaactgcaaggtggctctgtgcatgccaagcccaagggggaatgtgacccactctcatccttctggggcttctggcaaggggcacaggaaggactctggcctcaggaccttcctgctccacctgcagaggagatcctgccggagctggtgtccagtagtatgaaggccctgctccaggagatcaaggagcgcttcacctccagcctggtgagtgacagcagcgccttcagcaaaccaggcctccctccaggtggaagcccccagctggggtgcaccacgtctgggggactggaatagatgtttgtatggaactgaccttgatctccacgtgtatagttttcaagactgctctcctgcctgcctattatcccatctctatgactgggccaaaatcaatcttaaacgggaggggtaatcagacctctccaaagagtttcctgtccatgactgctggattgagtcacatgagtaactgctcctggacccggggactgtccacgaaaactgacttgcctgcttcctccttccaggaactggtttcttgcgcggaaaaagtgctcttgaggctggaggcagccacctctcccagcccactgggtggggaagcagctcagccctgatgcgggggagaagacagataccccacaggcccctccctccacgtgtgccctctccctgtccttcctttccatgggccactgtttcccttggggtggggggaagggtcatccagcaccagaatgcgcacctcacactcctcttaggtgactaataaagaggcccaaggccagtttctgccttaatcatttctggcaagaggctgtgactggccagtgggatacttaattctgcagtctctatagacctcgcccctggacagagcagtccttccagaccattctagatgagagtcaacactgagcctccacaggctccattccaagtaaacatctgcatttattttaaatcgcatcctcggtgtgtctgccccttttctgtccagctgtcaggtggcccaataacgccttggactccgtccccttgtcagtgccactggctgttcctggctctagttcccaggggagcctcaaactggggcctagcccagaaagccaccggctagcatcacatagcttctccagctcaaatagcccaaggttggcatgtctgccgacctccaggaataaccgcagtcaccgtgcccaggcaacacatcctcgtgctatggggagaagcctctgctgggtgacccaccagccaaccctgggccaatttaatttagataaatgctcaaagttcaaacggccacaggaaacccctgatgtaacacctgttgtgccggccagctgtgtctcaggagctgactgcagacacctggtctgggtccctcaagcccagcagagcttgttatgtcccctaacacaaaggaggaaaatgtggctcctcgagaggaaggtgctgagcacctcaccccagggtgtcaccgaagatgggcagtgacagcaccgtatggactggcggcccacaggccccaacctcacctggcccagggggtcagcagtcggtaaagcgtggccaggcgtgcccatggccgtccctgctccccaccctgaccatccgggcccaaacacacatggacagtaagaccaggtttcagaccacaaagtcaagaggaaggaggaccttctcagtagcaccacgccacgcccctctgccatgattctgaaaaggtttcaccagagttgccactctggggagatgtgatctgtccctgtgactggtcacattgcctctgtagcggggcggcagcagcagcagggcaggactgctaggcgtcgtcactgcagtggtctggagcagtcagcagggggcgcctgtctcgggccatgctctcccactccttcttcaccatgacgtacagcctcattgctgcctgggcatcctgaatctagacgacatgaaacatcccagcaggtgacgaggcatagccgcagcccacagtcaaccccacaatgactgagccctcccactagccactctgctacagatgtactgagtgagacatggacctggccacgagatgtcaccaggacggggagggaggacacaagagaagcagagggagcaacgacctgatggtccccacacttctgtgactcagacacccctcccaggagaagaaagggaaacccaaagaggagaagcaacaaacacgctgcctttttaggtctctgagtgcagggtgatggcaggttgggtgctgggcacaggggcacaaggaccaagcagatgggcaaaaagggcccaaagcactgaggccacgttggcagggggtgactgctccacagaggcagagccagctgctcagtggggccgggcagggcagggctggagggctgcgggggtggggggaccctttgtaattatttggcaactttttctccaaataacgagaatgcagtacttttgtgttaagtgttaaattcgttaaatgtgcatatttagaatttaaccaaaattccgtaactccgctctaccattttttttttttgaccaatagcctcgtaggataagtaggtgcccaagccccacctcccccatgtctgtgtcaggtgactcatgtctggttccaggtgggaaaccgccccaaaccccatgaactaccccacaggacacacttactgaacagtgctccgcctgctggacctggagcccaaggatcttctctgaaagtagtctcagagacggccttccactctgcaaagggggaagaggcgggtgggggcctctgcaggctcggcccaaagagggtcaccccaccaagcagggagcggttggctactgaacctcacccaagcgacctacagtttgcctctcagtggagaggtgctcatggcacttagggtggtagccaccagctgccatttatagcatgatgggctggtgatacacccctatcagccaataaaaggagagggccaggggaggagtcagcatccccatctcccatcttgaggcctccctgcttatttcaagagggacagctctggccaggcatggtggttcacacctgtaatctcagcacttaggaggccaacgagggcagatcacttgaacccaggagtttgagaatagccagggcaacacagcaagaccctatctctaaaaaaataaaaataaaaaaattagccaggggtggtggcatatgcctgcagtcccagctacttcagaggctaaggtggaaggattgcctgagcctgggaggtggcagttacagtgagccaagattatgccattgcactccagcctgggtgacagagcaagaccctgtctaaaaaaaaaaaaaaggatgaagaacggctctgcccttggcaccctctagagcagatacgacagtggtaccaggcccttagtcagtgaccctgtttcagaggttagagtggaaataacttgccctccgttgcaatcatttttaaggtcagcaattagcagaactctatttttaaacattccttctagttttaaaggttaaaagaaaaaacaaaaaccctttaaccaacaagtcagccaccagtgaccagaaacaatgaagtgaccagcaaaacagaatatcagtttcttgagtcacactctttctaggtacctttgcttgactcttgaaaggtttatatttctgtgtgtccagaatcttctttttggatgatcaagaaatagtacctagaaatttaaaatataatgataatcattttcatttttggtttgtagtagcagaaccccctccccccgccaccttttgcaagtaacatctgtgtgtgtgtgtgtgtgtgtgtgtgtgtgtgtgtgtgtgtgtgtgtgtgacggagtcttgctctgtcacccaggctggaatgcagtggctcaatctttgctgactgcaacctccgaccccaggtttcaagtgattctcctgcctcagcctcccgagtagctgggattacaagtgcccgccaccatgcctggctaatttttgtattttttagtagagacagggttttgccatgttggccaggctggtctcgaactcctgacctcaggtgatccacccgcctcggcctcccaaagtgctgggattacaggtgtgagccaacgcggctgccctgcaagtaacatcttgtagggaatccaagtgtgtcacacacacatggaaacaaggcactgatatgaatttcaactccagaaggaaatttattgcactgacttaagctgatgcccaacagtcagagacaataaaaacaaaatcttgaaatcaaggaagtaggagaaaaacagtcaacagttaaccagcaaccaacttattcctatattatacttgtattttgagttggttctacacatcaggaagttgcaaataacacattttaacagctcatcttgcaatcttagcatgcaattttttgttttgttttgttttttgataggatctcactctgtcacctgggctgcagtgctatagggtaatcatggctcactgcagccttaacctcctgggctcaactgatcctcctaccccagtctcctgagtagctgggacaacaggcacacgccaccacacctggctaattttaaaattttttatagagatggggtctcccctatgttactcaggctggtctctaactcccggcctcaagcaatcctccagcctcagcctcccaaaaagctgcgattacaggcataagccactgtgtctggtccttagcatcatcttcaagaaagacttgaacatgtgctgcgcaaggtgccagggatggagtcagagtcaggagggaaggacgagtccccacgccagcagtctctgagggggtacagcaggagcacacagaagacctttctgtgaggacactgcccggggggttctcacctcagtttcaccctctgtaaacaagcatgaacacctccagcatcttcaatggattcaagggatctctacagtgccgtcacgggagcaccatagcaaaggctgctgcctgaacattagcatctctgtcacttccttctgaacggcttcaagttcctcaccacactcaagtgcttcaagccggtgggcagaggtgacaacttaagtgtctctcccatctagcagactggcctccccgctgttcccactgtgtcctttaaaccaacatccaggcatttgcccataaactcaaagtgacccccaccctgttctcctgtaaatacacacgtactcgctctgcctgactcttcattcctgcctcgggtgaccaggagatggcaggctgccctccccacccatgacgccttccctgcccagggtctgtatatgtctttgaacttgtttcccacggtggtggtgtctgaatttgcactttccatctgaagaaccaggggctgccccaggcgggattttcctcgggacgccagaaagaaggcaaaggcaagctcccagggccagggtgatggttaggcaagcgtaacctgaacatgggccacagggcatctgccaggataaacttgtttcctgtggagggaccctggtcacggatgggacaactggacattaggccttcctccaggtaaaaggggtatcagcaccttcatttctcattagggcggggttgccagctgctctggtatgggtaccccagtttcgctgggggctctcaaaacaagagcctggcatggctcctaaaacacagtaagaactcagcacgcggtatctgatattattaccaaagtattcccaacatagagcacaaacccacacattgttaaaactccccaacacagcaagggcgtgagtgtaacacccacggagcaggggcaggctgagtccccaggagagagcccagtacctttaggtcattatgcagagcgtgccccactagaattctgcccttcagcatctctgcc

SEQ ID NO: 13267 - DNA, 14319 bp, Homo sapiens
ttggagaaggtcccggacctcatcagccaggtgttggccacctaccctgcggatggggaaatggcagaagccagctgcggagtcttctggctgctgtccctgctgggtgagctgggtgggcgccctgggcccctggggctgggaggggtgggcctcatggcacagcaggcacaaggcagcccggcccctttctgcaggctgcatcaaggagcagcagtttgaacaagtggtggcgctgctcctgcaaagcatccggctgtgccaggacagagccctgctggtgaacaatgcctaccggggactggccagcctggtgaaggtgtcaggtgagcctggggacaggacgaggctgccacctagaggtgggggcaagaatcagcccccatcagttacatctgccaggtgccacaaaccaaaaaacagaagcaacaaatcaaaaaggaaaagaaattaaaaacgatctgaagtccagtcatccagaaatcaccatcaagactttcacgcacacttgataaactcttgtctctgcgttatgctaccctgtgaccctctctctgtccataaacacatcacatctgcacaggtttcctaacatgcaggcacaccgtgactgatcaaaacagctctgcaaacagtgtctccaattccccacaacacaaaccctgcctgttactcagctagacaggctgggcccagcgctgagcacagcacaaccgacgctcggcccacagcacagtccttcagagagcatcctgggcctggccaagacactagctggtgcctggcaactccgggctcatggtcttgacctctgtactacctaatcttccccagagtgacaacgacccctttggctctgggggggctgcctcctctgttcttgcatggtcctgttcaggtcatgccagcctactggtccgcccaagctgatggggcctcctgggtcccgtctcttgtcctgtcccaggcccctgtgtgagctctggggtcccatcccgtcctgggcagaaggctcttccctttcaggggaaagcagggaatgaacccactcccacccatcccccagagctggcggccttcaaggtggtggtgcaggaggagggcggcagtggcctcagcctcatcaaggagacctaccagctccacagggacgacccggaggtggtggagaacgtgggcatgctgctggtccacctggcttcctatggtgagaaccccttctcacctcacactccctagagcccagcggtcaggggtgccccgctccccctataactgacagggaaggagcacatggaaggtgggctcaaccccacttctcggcccacttaaacttcccactcatttggcatcttctgagcaccaggggttgtcctggctgagggtgacgcttggggctccggaactgcaaggtggctctgtgcatgccaagcccaagggggaatgtgacccactctcatccttctggggcttctggcaaggggcacaggaaggactctggcctcaggaccttcctgctccacctgcagaggagatcctgccggagctggtgtccagtagtatgaaggccctgctccaggagatcaaggagcgcttcacctccagcctggtgagtgacagcagcgccttcagcaaaccaggcctccctccaggtggaagcccccagctggggtgcaccacgtctgggggactggaatagatgtttgtatggaactgaccttgatctccacgtgtatagttttcaagactgctctcctgcctgcctattatcccatctctatgactgggccaaaatcaatcttaaacgggaggggtaatcagacctctccaaagagtttcctgtccatgactgctggattgagtcacatgagtaactgctcctggacccggggactgtccacgaaaactgacttgcctgcttcctccttccaggaactggtttcttgcgcggaaaaagtgctcttgaggctggaggcagccacctctcccagcccactgggtggggaagcagctcagccctgatgcgggggagaagacagataccccacaggcccctccctccacgtgtgccctctccctgtccttcctttccatgggccactgtttcccttggggtggggggaagggtcatccagcaccagaatgcgcacctcacactcctcttaggtgactaataaagaggcccaaggccagtttctgccttaatcatttctggcaagaggctgtgactggccagtgggatacttaattctgcagtctctatagacctcgcccctggacagagcagtccttccagaccattctagatgagagtcaacactgagcctccacaggctccattccaagtaaacatctgcatttattttaaatcgcatcctcggtgtgtctgccccttttctgtccagctgtcaggtggcccaataacgccttggactccgtccccttgtcagtgccactggctgttcctggctctagttcccaggggagcctcaaactggggcctagcccagaaagccaccggctagcatcacatagcttctccagctcaaatagcccaaggttggcatgtctgccgacctccaggaataaccgcagtcaccgtgcccaggcaacacatcctcgtgctatggggagaagcctctgctgggtgacccaccagccaaccctgggccaatttaatttagataaatgctcaaagttcaaacggccacaggaaacccctgatgtaacacctgttgtgccggccagctgtgtctcaggagctgactgcagacacctggtctgggtccctcaagcccagcagagcttgttatgtcccctaacacaaaggaggaaaatgtggctcctcgagaggaaggtgctgagcacctcaccccagggtgtcaccgaagatgggcagtgacagcaccgtatggactggcggcccacaggccccaacctcacctggcccagggggtcagcagtcggtaaagcgtggccaggcgtgcccatggccgtccctgctccccaccctgaccatccgggcccaaacacacatggacagtaagaccaggtttcagaccacaaagtcaagaggaaggaggaccttctcagtagcaccacgccacgcccctctgccatgattctgaaaaggtttcaccagagttgccactctggggagatgtgatctgtccctgtgactggtcacattgcctctgtagcggggcggcagcagcagcagggcaggactgctaggcgtcgtcactgcagtggtctggagcagtcagcagggggcgcctgtctcgggccatgctctcccactccttcttcaccatgacgtacagcctcattgctgcctgggcatcctgaatctagacgacatgaaacatcccagcaggtgacgaggcatagccgcagcccacagtcaaccccacaatgactgagccctcccactagccactctgctacagatgtactgagtgagacatggacctggccacgagatgtcaccaggacggggagggaggacacaagagaagcagagggagcaacgacctgatggtccccacacttctgtgactcagacacccctcccaggagaagaaagggaaacccaaagaggagaagcaacaaacacgctgcctttttaggtctctgagtgcagggtgatggcaggttgggtgctgggcacaggggcacaaggaccaagcagatgggcaaaaagggcccaaagcactgaggccacgttggcagggggtgactgctccacagaggcagagccagctgctcagcggggccgggcagggcagggctggagggctgcgggggtggggggaccctttgtaattatttggcaactttttctccaaataacgagaatgcagtacttttgtgttaagtgttaaattcgttaaatgtgcatatttagaatttaaccaaaattccgtaactccgctctaccattttttttttttgaccaatagcctcgtaggataagtaggtgcccaagccccacctcccccatgtctgtgtcaggtgactcatgtctggttccaggtgggaaaccgccccaaaccccatgaactaccccacaggacacacttactgaacagtgctccgcctgctggacctggagcccaaggatcttctctgaaagtagtctcagagacggccttccactctgcaaagggggaagaggcgggtgggggcctctgcaggctcggcccaaagagggtcaccccaccaagcagggagcggttggctactgaacctcacccaagcgacctacagtttgcctctcagtggagaggtgctcatggcacttagggtggtagccaccagctgccatttatagcatgatgggctggtgatacacccctatcagccaataaaaggagagggccaggggaggagtcagcatccccatctcccatcttgaggcctccctgcttatttcaagagggacagctctggccaggcatggtggttcacacctgtaatctcagcacttaggaggccaacgagggcagatcacttgaacccaggagtttgagaatagccagggcaacacagcaagaccctatctctaaaaaaataaaaataaaaaaattagccaggggtggtggcatatgcctgcagtcccagctacttcagaggctaaggtggaaggattgcctgagcctgggaggtggcagttacagtgagccaagattatgccattgcactccagcctgggtgacagagcaagaccctgtctaaaaaaaaaaaaaaggatgaagaacggcttctgcccttggcaccctctagagcagatacgacagtggtaccaggcccttagtcagtgaccctgtttcagaggttagagtggaaataacttgccctccgttgcaatcatttttaaggtcagcaattagcagaactctatttttaaacattccttctagttttaaaggttaaaagaaaaaacaaaaaccctttaaccaacaagtcagccaccagtgaccagaaacaatgaagtgaccagcaaaacagaaatacagtatcttgagtcacactcattctaagtacctttacttgactcttgaaaggtttatatttctgtgtgtcccgaatcttcttttttggatgatcaagaaatagtacctagaaaaataaaatataatgataatcattttcatttttggtttgtagtagcagaaccccctccccccgccaccttttgcaagtaacatctgtgtgtgtgtgtgtgtgtgtgtgtgtgtgtgtgtgtgtgtgtgtgtgtgtgtgtgtgacggagtcttgctctgtcacccaggctggaatgcagtggctcaatctttgctgactgcaacctccgaccccaggtttcaagtgattctcctgcctcagcctcccgagtagctgggattacaagtgcccgccaccatgcctggctaatttttgtattttttagtagagacagggttttgccatgttggccaggctggtctcgaactcctgacctcaggtgatccacccgcctcggcctcccaaagtgctgggattacaggtgtgagccaacgcggctgccctgcaagtaacatcttgtagggaatccaagtgtgtcacacacacatggaaacaaggcactgatatgaatttcaactccagaaggaaatttattgcactgacttaagctgatgcccaacagtcagagacaataaaaacaaaatcttgaaatcaaggaagtaggagaaaaacagtcaacagttaaccagcaaccaacttattcctatattatacttgtattttgagttggttctacacatcaggaagttgcaaataacacattttaacagctcatcttgcaatcttagcatgcaattttttgttttgttttgttttttgataggatctcactctgtcacctgggctgcagtgctatagggtaatcatggctcactgcagccttaacctcctgggctcaactgatcctcctaccccagtctcctgagtagctgggacaacaggcacacgccaccacacctggctaattttaaaattttttatagagatggggtctcccctatgttactcaggctggtctctaactcccggcctcaagcaatcctccagcctcagcctcccaaaaagctgcgattacaggcataagccactgtgtctggtccttagcatcatcttcaagaaagacttgaacatgtgctgcgcaaggtgccagggatggagtcagagtcaggagggaaggacgagtccccacggcagcagtctctgagggggtacagcaggagcacacagaagacctttctgtgaggacactgcccggggggttctcacctcagtttcaccctctgtaaacaagcatgaacacctccagcatcttcaatggattcaagggatctctacagtgccgtcacgggagcaccatagcaaaggctgctgcctgaacattagcatctctgtcacttccttctgaacggcttcaagttcctcaccacactcaagtgcttcaagccggtgggcagaggtgacaacttaagtgtctctcccatctagcagactggcctccccgctgttcccactgtgtcctttaaaccaacatccaggcatttgcccataaactcaaagtgacccccaccctgttctcctgtaaatacacacgtactcgctctgcctgactcttcattcctgcctcgggtgaccaggagatggcaggctgccctccccacccatgacgccttccctgcccagggtctgtatatgtctttgaacttgtttcccacggtggtggtgtctgaatttgcactttccatctgaagaaccaggggctgccccaggcgggattttcctcgggacgccagaaagaaggcaaaggcaagctcccagggccagggtgatggttaggcaagcgtaacctgaacatgggccacagggcatctgccaggataaacttgtttcctgtggagggaccctggtcacggatgggacaactggacattaggccttcctccaggtaaaaggggtatcagcaccttcatttctcattagggcggggttgccagctgctctggtatgggtaccccagtttcgctgggggctctcaaaacaagagcctggcatggctcctaaaacacagtaagaactcagcacgcggtatctgatattattaccaaagtattcccaacatagagcacaaacccacacattgttaaaactccccaacacagcaagggcgtgagtgtaacacccacggagcaggggcaggctgagtccccaggagagagcccagtacctttaggtcattatgcagagcgtgccccactagaattctgcccttcagcatctctgccacttccttctgaacaacttcaagctcttctcctggaaaatcaacacaaagaagcggttttttgcaacacacacatcaccatcattctgtgaggaggcagccccgctcctacccctggtcagacctaagacaaatggtcaggcctgcaatgccactacggagggtgactcgaagccaccacatccacccacccccctgggagaagtgccttgtgggcccctggcaggggtggctgcgagaaccacctctgaggagaggaataaagtgctccacacagtctgcaaagtcggctcatggctggaggagagcatatgttgagtgtaggcactgagaaacttttagagccgcctggcagcgtggttctgcctattcaacctcatgatttacttgacaatttcccaaatggaaataaaaacaaaactgcccccacaaaaatgggtagagatgtgttgccctaggccctgggctccagaggcagccttgcctgcttctggggaccaccccaccaccaaccccacttgtaccccccgaacaggggtgattagaccaagggtggcccgagccaagtgggaccagctaattttttaaaaatattttttagaaggccaggtgcagtgggtcatgcctgtaattccagcactttgggaggcggaggcaggcggatcacctgagttcgggagttcaagaccagcctgaccaatgtggagaaaccctgtctctacttaaaataaaaaattagtcgggtgtggtggcatatgcctgtaatcccagctactcgggaggctgaggcaggagaatcgcttgaacccaggaggcggaggttgcagtgagcccagattgtgccattgcacttcagcctgggcaacaagagcaaaactccatctcaaaaaaaaataataattttttttagaaatgaggtctcgctatgttgtccaggctggacttgaactcctgggttcaagcaatcctccctcctcagcctcctgagtagctgggactacaggcatgagccaccgtgcccagctactggcctggtcttgaagtcagcggacaggaggcaatgaagtgcaaggcataaatgggtgtaaagccgtctaaggatgccttttgtattttaaaacccatcgccccaaaaggagacaagacgcatcaaaaccagctgcagtgagtggtctcagacagaaaagggaacaaaagggagaaaacgaatccagttactactttcccttctaagttcctgagctgtggatgacataccctgcttgaggttctcaggccgaatcccactgaccgctgtcctatagtccgtcacgggctcagttggtttgacgtacttgtcataaacgcacttcccatactggttcacgatggacacacgggcggccatgctctcctcccccttagggcccacgcccaccatctcacagtccaaggctaaggctcttgtcaggctgaagggtaaccaaaggctgtagtttaataaacacggcaggccacagggctccaggtcagagccccagggatccatggactaagtgtcagcagagaaaagctctctgcccctcactcatttgcacccacgtgacaagctctgtgtggtcctggttcttagcaggaccctgggaggtgcttgcctcattcacctcagggagaggaaagcatcctcttccttgaagaagccccgccctccacggctaagcatccccagcagaccccactccctgagaccagcgtacccgccgaaggcctgctctttcacgaggctgaggctgacgctgccctcgctctgacccaactgtttcctcgctatcttggccgcctctggacctatggcagcttcgatatccgctgggtccacgtcgtcaaaccagatgtcttccctaaaaggcaaagataacaggctgatcaccagaagaccctagtgcaactggtggggtggggctgtggggctgactgtgcaggtgagtggagcgatggcacagcctgcctctcccacaggctggccccagacaccccgactgctggccctgctgcttctgctattttgatcatcttggcattttccttttttttttgagatggagtctcactgggtcacccaacctggagtgcagtggcatgatcttggctcactgcaacctttgcctcccaggttcaagtgattctcttgtctcagcctccctagtagctgggattttacaggcgcccactgccacgcctggctaattttttgtattttcagtagatacggggtttcgtcatgttggccaggctggtcttgaactcctgacctcaagtgatccacctgcctcggcctcccaaagagctgggattacaggtgtgagtcacagcacctggcctcatctcttttctttttaattagaaaatacactcattattcaagatttaggaacacagacaaacacaaagaatataaaacagaaacacataacccaccacccaagtgtaatgagtgctaacattttaattatgaaggtaacacgttcattattgaacacttaggaaacagacagacagaatgcctgtaagatggaaacacagaaccccttgccctccgtactaggaagctcacacaggcacgtaacacctgcctggggaatctgtctcttgggctaaggttaaatgtcatttccttagaaaagccattcctggccccactgaatggacacgtccctcttgttccaggcacccaataccttctcctcactagatttatcctgaccacacttaatcaacagctgcagtttacagtctgtctactgcacttgacaataagcctcaagagggaggagcaggcccacctcactgaactctatcccagacagcctgcctagcacaacacagggaggcccccaaatggctcattcctcagccatcagcgactgtgtcctgaacacccaggcaacatgaagccagctgtaacttatgaacacgtcacctccagctgaaccattcagagaaggccactgactcccggtccaccccacgtgggtggccagcacagggtttattcttttcacttgtttttttgagagtcttgctccgtcacccgggctggaggcagtagtgcaatcacagctcactgcagcctcaacctcctgggatcaagtgatcctcccaccttggcctcccaaggagctgggatcacaggcaacagccaccacacctggctccatcacagggttgaagtaatcaccaggcactgagccaagagtgccaacctcacaatctccttatgatgccaccatgactaccacaaggcacagaggacgtcagaaacttgccccaaaccacccaactggcgagaagcagggacaggcctcatacttgggtctttctggcttcagcacgctttccttccacacacgtgtactggcacccactaaatgctgagctctgctcaacgctcggaagaagcaggccctgccttatcatgcgcacactctaggggaaaacaagtaacagcgagtaaacaaaggaacagacgacatcagggtaaagtgatggagagactgcggtgaggccaccagccttccataaggagacaggccttggtgaagtcgctgtgcctcggttctcagtggtgaggtggcccatacttactcggtgggtggggctggggctgcctccttagctttccgcttcttatgctcgatgtcccctcgttctggaacaatatcaccatttgtcctttccttggttcctttcttattgtgctctgttccactggccttggtgcgaggtactggcgccctcctgtccatcttggaacctgaaggaacagagcccctgctggcctcctggtcttttcctgccggcatctcctctcccttcacttgaggcgaggtctcttttttgttttgctggataattttgggcttctttttggaacccatctgagagatgacaagaggcttttctggggcctgagatttttgtttcagcagccactgggacccaaaataaaatacatgctgcatttgaatttggaaattacacacagcagattgaaaaaacttacgtgtgtatgtatatacacacatatacaccaaacacatctatacaattcccatccgcatcactgaaattcattttcaaacggtttggaaaaagctctttttcattctcatgggtcacttgtggtgaaatgctgtttctttgcttatcttattataatgcattttgcacctgctccttcatgcatacaaaatgtcaaactcattctacaccttgggtacctgttgagtggctggacaccacagaccacttcccttttcagcttatctagaaagaattttggagttaacttccctcacagcttgggccaacatcctgctacacagaaatcgctttttttttttttacaagattccctggtttgctactgctgtgaagatctcaggaaggtggggggtgtcataaatgaaaagaaaagcttctgtcaaactggagtggctgaagaactgctagcagccacacaccttggctgtcacccaagcagaggctcctgtagtcttagagcccagcttcctccctgtgttcaaatccccagtgggagtgggcgccaccacagtgcgatgatgaggcgggtgctacttacctgttctgtgataggtaaagaactgaagggctgactttcttggatgaattagaaaacactccaaagtttccctatagcacacatcccttccattcacttattttgcttttctttcttgggagaaggaagaagagttggtgttcaagaaatcccacagaaccctggggctgcccacgggaatttgactggtcctgtgtgttaagacaggaatgtctgcactgagatactgtgcagagtattaggaggttcaagaagcgctcggggaggctgaggtgggaggattgcttgaggtcaggagttgaagaccagcctgggcaacaaagtgaaaccccatctgtattagttcattgtgcactgctataaaggaatacctgtgtttggtaatttataaagaaaaaacgtttatgtagctcatggttttgcaggttgtacaagaagcatggtgccagcatctgcttctggtgaggccgaaggaagcttcccatcatggtgtaaggtgaagggggagcaggtgtgttgcgtggtgagagagcaagcaaaaaaggtgctaggctctttttaaacaaccagctctcaaatgaaccagcagagtgagaacttactcgttactgaggggagggcaccaagtcattcatgagggatctacccccatgacccaatacctcctatgggccccatctccaccactggggatcacatttcttttttaaaaaaactactttttacttttatttagagatggaatctcaccatgttgcccaggctggacttgaactcctgagctcaagtgatcctcctgcctgggcctcccaaagtgctgggattacacgtgtgggctactcgggaggctgaggcaggagaatcactggagcccaggcagcagtgagctatgatcctaacaggaggtagctccaagggagctccaagggatgtggtaagaatgtatgagtgacgcacgtggaagagtgtctgggagagagcaggcaacctctacagaagtgcaggtcactagggagacagcaggtacaacacagccttaaaagcatggactccagagtcagccacctggttcccagccgcaatcttagatgatctatttaaacttttccagcctatttcctcatctgtacaatagagatgatgaaagtgtccacctcacagtcttattgtggggattgcaacacacatggcatagagcacatggcagagtgcacatttttaggagctcaattagtatttacttcaagaccgtaagtgtcgctagaaccccatcacatgtctgctatctgcttttcacttctacacaggaatcttctttctccctgtcttgctacacagaccagtgtgttctttcgttgttgttgtttgagatggagtctcgctctgtcgcccaggctggagtgcagtggcgcgatttcggcttactactgcctctgcctcccgggttcaagcgattcttctgcctcaggctccccgagtagctgcgactaccggcgcgcgccatcacgcccggctaatattttttgtacttttttagtagacacggggtttcaccatgttggccgggctggtcttgaactcttgacctcaggggatctgcccgcctcggcctcccaaagtgctgggatcacaggcgtgaggccccgcgcccggcctggtttcgggattttaagctaaatttctctttgtaaaatccattctagttagttcattatgcaaaaggtacaagggtttatctttgcttttttgtacttgaaataattctttcatcaatttctttcaagcaaacaagttcgagacctccctcaacaggccacctttcttgtgaaaagctgtttacaagatttcgattcaaatctgcctttacaggtcttttggggctacccaagtctttccctccgtcgcgttctgcgggaatgagctgcgcagcgctccgcccgggccccctcaagcctcacctcttgcagcgccttccagttttgagaaaagtcttctggtgcctttggaggtcgcaccacagcaccggggccgcttgctggcttcttgcttacttcccgcgccttgcttttccaaaacctttttttcttcttgtttttcttccgagtgagcgtcttgacaggacccggcttagccacggggctgctcggggcgcgcttggaggcggggaccttcgccttccccatcctgctgccgtccagcgcctgggccggcggccacccgagaccccggcctccccgggcccggcgccctggcagcacaagcgcctgcccaggccagtccgaaacacacccaccgcagggaccccgtccaggaaaagactccggaagagaccccgcacgcgttgcgcatacctcagcacgcacgctccagtccc

SEQ ID NO: 13268 - DNA, 14353 bp, Homo sapiens
  misc_feature (76)..(76): n equals a,t,g, or c
  misc_feature (79)..(79): n equals a,t,g, or c
  misc_feature (128)..(128): n equals a,t,g, or c
  misc_feature (147)..(147): n equals a,t,g, or c
  misc_feature (256)..(256): n equals a,t,g, or c
  misc_feature (851)..(851): n equals a,t,g, or c
  misc_feature (862)..(862): n equals a,t,g, or c
  misc_feature (892)..(892): n equals a,t,g, or c
  misc_feature (1259)..(1259): n equals a,t,g, or c
  misc_feature (1545)..(1546): n equals a,t,g, or c
  misc_feature (1670)..(1670): n equals a,t,g, or c
  misc_feature (1999)..(1999): n equals a,t,g, or c
  misc_feature (2193)..(2193): n equals a,t,g, or c
  misc_feature (2196)..(2196): n equals a,t,g, or c
  misc_feature (2209)..(2209): n equals a,t,g, or c
  misc_feature (2511)..(2511): n equals a,t,g, or c
  misc_feature (2887)..(2887): n equals a,t,g, or c
  misc_feature (2939)..(2939): n equals a,t,g, or c
  misc_feature (3722)..(3722): n equals a,t,g, or c
  misc_feature (4108)..(4108): n equals a,t,g, or c
  misc_feature (5285)..(5290): n equals a,t,g, or c
  misc_feature (5911)..(5911): n equals a,t,g, or c
  misc_feature (6197)..(6197): n equals a,t,g, or c
  misc_feature (6776)..(6776): n equals a,t,g, or c
  misc_feature (7411)..(7411): n equals a,t,g, or c
  misc_feature (9084)..(9084): n equals a,t,g, or c
  misc_feature (9116)..(9116): n equals a,t,g, or c
  misc_feature (9627)..(9627): n equals a,t,g, or c
  misc_feature (10052)..(10052): n equals a,t,g, or c
  misc_feature (10508)..(10508): n equals a,t,g, or c
  misc_feature (10518)..(10518): n equals a,t,g, or c
  misc_feature (10908)..(10908): n equals a,t,g, or c
  misc_feature (12883)..(12883): n equals a,t,g, or c
  misc_feature (12901)..(12901): n equals a,t,g, or c
  misc_feature (13301)..(13301): n equals a,t,g, or c
  misc_feature (13469)..(13469): n equals a,t,g, or c
ttggagaaggtcccggacctcatcagccaggtgttggccacctaccctgcagatggggaaatggcggaagccagcntgncggagtcttctggctgctgtccctgctgggtgagctgggtgggcgcccntgggcccctggggctgggnaggggtgggcctcatggcacagcaggcacaaggcagcccggcccctttctgcaggctgcatcaaggagcagcagtttgaacaagtggtggcgctgctcctgcaaagcantccggctgtgccaggacagagccctgctggtgaacaatgcctaccggggactggccagcctggtgaaggtgtcaggtgagcctggggacaggacgaggctgccacctagaggtgggggcaagaatcagcccccatcagttacatctgccaggtgccacaaaccaaaaaacagaagcaacaaatcaaaaaggaaaagaaattaaaaacgatctgaagtccagtcatccagaaatcaccatcaagactttcacgcacacttgataaactcttgtctctgcgttatgctaccctgtgaccctctctctgtccataaacacatcacatctgcacaggtttcctaacatgcaggcacaccgtgactgatcaaaacagctctgcaaacagtgtctccaattccccacaacacaaaccctgcctgttactcagctagacaggctgggcccagcgctgagcacagcacaaccgacgctcggcccaccgcacagtccttcagagagcatcctgggcctggccaagacactagctggtgcctggcaactccgggctcatggtcttgacctctgtactacctaatcttccccagagtgacaacgancccctttggcntctgggggggctgcctcctctgttcttgcnatggtcctgttcaggtcatgccagcctactggtccgcccaagctgatggggcctcctgggtcccgtctcttgtcctgtcccaggcccctgtgtgagctctggggtcccatcccgtcctgggcagaaggctcttccctttcaggggaaagcagggaatgaacccactcccacccatcccccagagctggcggccttcaaggtggtggtgcaggaggagggcggcagtggcctcagcctcatcaaggagacctaccagctccacagggacgacccggaggtggtggagaacgtgggcatgctgctggtccacctggcttcctatggtgagaaccccttctcacctcacactccctagagcccagcggtncaggggtgccccgctccccctataactgacagggaaggagcacatggaaggtgggctcaaccccacttctcggcccacttaaacttcccactcatttggcatcttctgagcaccaggggttgtcctggctgagggtgacgcttggggctccggaactgcaaggtggctctgtgcatgccaagcccaagggggaatgtgacccactctcatccttctggggcttctggcaaggggcacaggaaggactctggcctcaggaccttcctgctccacctgcagaggaganntcctgccggagctggtgtccagtagtatgaaggccctgctccaggagatcaaggagcgcttcacctccagcctggtgagtgacagcagcgccttcagcaaaccaggcctccctccaggtggaangcccccagctggggtgcaccacgtctgggggacgggaatagatgtttgtatggaactgaccttgatctccacgtgtatagttttcaagactgctctcctgcctgcctattatcccatctctatgactgggccaaaatcaatcttaaacgggaggggtaatcagacctctccaaagagtttcctgtccatgactgctggattgagtcacatgagtaactgctcctggacccggggactgtccacgaaaactgacttgcctgcttcctccttccaggaactggtttcttgcgcggaaaaagtgctcttgaggctggaggcagccacctctncccagcccactgggtggggaagcagctcagccctgatgcgggggagaagacagataccccacaggcccctccctccacgtgtgccctctccctgtccttcctttccatgggccactgtttcccttggggtggggggaagggtcatccagcaccagaatgtgcatctcacactcctcttaggtgactaataaagnagngcccaaggccagntttctgccttaatcatttctggcaagaggctgtgactggccagtgggatacttaattctgcagtctctatagacctcgcccctggacagagcagtccttccagaccattctagatgagagtcaacactgagcctccacaggctccattccaagtaaacatctgcatttattttaaatcgcatcctcggtgtgtctgccccttttctgtccagctgtcaggtggcccaataacgccttggactccgtccccttgtcagtgccactggctgttcctggctctagttcccaggggagcctcaaanctggggcctagcccagaaagccaccggctagcatcacatagcttctccagctcaaatagcccaaggttggcatgtctgccgacctccaggaataaccgcagtcaccgtgcccaggcaacacatcctcgtgctatggggagaagcctctgctgggtgacccaccagccaaccctgggccaatttaatttagataaatgctcaaagttcaaacggccacaggaaacccctgatgtaacacctgttgtgccggccagctgtgtctcaggagctgactgcagacacctggtctgggtccctcaagcccagcagagcttgttatgtcccctaacacaaaggaggaaaatgtggctcctcgagaggaaggtgctgagcaccntcaccccagggtgtcaccgaagatgggcagtgacagcaccgtatggactggncggcccacaggccccaacctcacctggcccagggggtcagcagtcggtaaagcgtggccaggcgtgcccatggccgtccctgctccccaccctgaccatccgggcccaaacacacatggacagtaagaccaggtttcagaccacaaagtcaagaggaaggaggaccttctcagtagcaccacgccacgcccctctgccatgattctgaaaaggtttcaccagagttgccactctggggagatgtgatctgtccctgtgactggtcacattgcctctgtagcggggcggcagcagcagcagggcaggactgctaggcgtcgtcactgcagtggtctggagcagtcagcagggggcgcctgtctcgggccatgctctcccactccttcttcaccatgacgtacagcctcattgctgcctgggcatcctgaatctagacgacatgaaacatcccagcaggtgacgaggcatagccgcagcccacagtcaaccccacaatgactgagccctcccactagccactctgctacagatgtactgagtgagacatggacctggccacgagatgtcaccaggacggggagggaggacacaagagaagcagagggagcaacgacctgatggtccccacacttctgtgactcagacacccctcccaggagaagaaagggaaacccaaagaggagaagcaacaaacacgctgcctttttaggtctctgagtgcagggtgatggcaggttgggtgctgggcacaggggcacaaggaccaagcagatgggcaaaaangggcccaaagcactgaggccacgttggcagggggtgactgctccacagaggcagagccagctgctcagcagggccgggcagggcagggctggagggctgcgggggtggggggaccctttgtaattatttggcaactttttctccaaataacgagaatgcagtacttttgtgttaagtgttaaattcgttaaatgtgcatatttagaatttaaccaaaattccgtaactccgctctaccattttttttttttgaccaatagcctcgtaggataagtaggtgcccaagccccacctcccccatgtctgtgtcaggtgactcatgtctggttccaggtgggaaaccgccccaaaccccatgaactaccccacaggacacacttactganacagtgctccgcctgctggacctggagcccaaggatcttctctgaaagtagtctcagagacggccttccactctgcaaagggggaagaggcgggtgggggcctctgcaggctcggcccaaagagggtcaccccaccaagcagggagcggttggctactgaacctcacccaagcgacctacagtttgcctctcagtggagaggtgctcatggcacttagggtggtagccaccagctgccatttatagcatgatgggctggtgatacacccctatcagccaataaaaggagagggccaggggaggagtcagcatccccatctcccattttgaggcctccctgcttatttcaagagggacagctctggccaggcatggtggttcacacctgtaatctcagcacttaggaggccaacgagggcagatcacttgaacccaggagtttgagaatagccagggcaacacagcaagaccctatctctaaaaaaataaaaataaaaaaattagccaggggtggtggcatatgcctgcagtcccagctacttcagaggctaaggtggaaggattgcctgagcctgggaggtggcagttacagtgagccaagattatgccattgcactccagcctgggtgacagagcaagaccctgtctaaaaaaaaaaaaaaggatgaagaacggctctgcccttggcaccctctagagcagatacgacagtggtaccaggcccttagtcagtgaccctgtttcagaggttagagtggaaataacttgccctccgttgcaatcatttttaaggtcagcaattagcagaactctatttttaaacattccttctagttttaaaggttaaaagaaaaaacaaaaaccctttaaccaacaagtcagccaccagtgaccagaaacaatgaagtgaccagcaaaacagaaatacagtatcttgagtcacactcattctaagtacctttacttgactcttgaaaggtttatatttctgtgtgtcccgaatcttcttttttggatgatcaagaaatagtacctagaaaaataaaatataatgataatcattttcatttttggtttgtagtagcagaaccccctccccccgccaccttttgcaagtaacatctttgtgtgtgtgtgtgtgtgtgtgtgtgtgtgtgtgtgtgtgtgtgtgtgtgannnnnncggagtcttgctctgtcacccaggctggaatgcagtggctcaatctttgctgactgcaacctccgaccccaggtttcaagtgattctcctgcctcagcctcccgagtagctgggattacaagtgcccgccaccatgcctggctaatttttgtattttttagtagagacagggttttgccatgttggccaggctggtctcgaactcctgacctcaggtgatccacccgcctcggcctcccaaagtgctgggattacaggtgtgagccaacgcggctgccctgcaagtaacatcttgtagggaatccaagtgtgtcacacacacatggaaacaaggcactgatatgaatttcaactccagaaggaaatttattgcactgacttaagctgatgcccaacagtcagagacaataaaaacaaaatcttgaaatcaaggaagtaggagaaaaacagtcaacagttaaccagcaaccaacttattcctatattatacttgtattttgagttggttctacacatcaggaagttgcaaataacacattttaacagctcatcttgcaatcttagcatgcaattttttgttttgttttgttttttgataggatctcactctgtcacctgggnctgcagtgctatagggtaatcatggctcactgcagccttaacctcctgggctcaactgatcctcctaccccagtctcctgagtagctgggacaacaggcacacgccaccacacctggctaattttaaaattttttatagagatggggtctcccctatgttactcaggctggtctctaactcccggcctcaagcaatcctccagcctcagcctcccaaaaagctgcgattacaggcataagccactgtgtctggtccttagcatcatcttcaagaaagacttgaacnatgtgctgcgcaaggtgccagggatggagtcagagtcaggagggaaggacgagtccccacggcagcagtctctgagggggtacagcaggagcacacagaagacctttctgtgaggacactgcccggggggttctcacctcagtttcaccctctgtaaacaagcatgaacacctccagcatcttcaatggattcaagggatctctacagtgccgtcacgggagcaccatagcaaaggctgctgcctgaacattagcatctctgtcacttccttctgaacggcttcaagttcctcaccacacccaagtgcttcaagccggtgggcagaggtgacaacttaagtgtctctcccatctagcagactggcctccccgctgttcccactgtgtcctttaaaccaacatccaggcatttgcccataaactcaaagtgacccccaccctgttctcctgtaaatacacacgtactcgctctgcctgactcttcattcctgcctcgggtgaccaggagatggcaggctgccctccccacccatgacgccttccctgcccagggtctgtatatgtctttgaacttgtttncccacggtggtggtgtctgaatttgcactttccatctgaagaaccaggggctgccccaggcgggattttcctcgggacgccagaaagaaggcaaaggcaagctcccagggccagggtgatggttaggcaagcgtaacctgaacatgggccacagggcatctgccaggataaacttgtttcctgtggagggaccctggtcacggatgggacaactggacattaggccttcctccaggtaaaaggggtatcagcaccttcatttctcattagggcggggttgccagctgctctggtatgggtaccccagtttcgctgggggctctcaaaacaagagcctggcatggctcctaaaacacagtaagaactcagcacgcggtatctgatattattaccaaagtattcccaacatagagcacaaacccacacattgttaaaactccccaacacagcaagggcgtgagtgtaacacccacggagcaggggcaggctgagtccccaggagagagcccagtacctttaggtcattatgcagagcgtgccccactagaattctgcccttcagcatctctgccacttccttctgaacaacttcaagctcttctcctggaaaatcaacacaaagaagcggttttttngcaacacacacatcaccatcattctgtgaggaggcagccccgctcctacccctggtcagacctaagacaaatggtcaggcctgcaatgccactacggagggtgactcgaagccaccacatccacccacccccctgggagaagtgccttgtgggcccctggcaggggtggctgcgagaaccacctctgaggagaggaataaagtgctccacacagtctgcaaagtcggctcatggctggaggagagcatatgttgagtgtaggcactgagaaacttttagagccgcctggcagcgtggttctgcctattcaacctcatgatttacttgacaatttcccaaatggaaataaaaacaaaactgcccccacaaaaatgggtagagatgtgttgccctaggccctgggctccagaggcagccttgcctgcttctggggaccaccccaccaccaaccccacttgtaccccccgaacaggggtgattagaccaagggtggcccgagccaagtgggaccagctaattttttaaaaatattttttagaaggccaggtgcagtgggtcatgcctgtaattccagcactttgggaggcggaggcaggcggatcacctgagttcgggagttcaagaccagcctgaccaatgtggagaaaccctgtctctacttaaaatacaaaattagtcgggtgtggtggcatatgcctgtaatcccagctactcgggaggctgaggcaggagaatcgcttgaacccaggaggcggaggttgcagtgagcccagattgtgccattgcacttcagcctgggcaacaagagcaaaactccatctcaaaaaaaaataataattttttttagaaatgaggtctcgctatgttgtccaggctggacttgaactcctgggttcaagcaatcctccctcctcagcctcctgagtagctgggactacaggcatgagccaccgtgcccagctactggcctggtcttgaagtcagcggacaggaggcaatgaagtgcaaggcataaatgggtgtaaagccgtctaaggatgccttttgtattttaaaacccatcgccccaaaaggagacaagacgcatcaaaaccagctgcagtgagtggtctcagacagaaaagggaacaaaagggagaaaacgaatccagttactactttcccttctaagttcctgagctgtggatgacataccctgcttgaggttctcaggccgaatcccactgaccgctgtcctatagtccgtcacgggctcggttggtttgacgtacttgtcataaacgcacttcccatactggttcacgatggacacacgggcggccatgctctcctcccccttagggcccacgcccaccatctcacagtccaaggctaaggctcttgtcaggctgaagggtaaccaaaggctgtagtttaataaacacggcaggccacagggctccaggtcagagccccagggatccatggactaagtgtcagcagagaaaagctctctgcccctcactcatttgcacccacgtgacaagctctgtgtggtcctggttcttagcaggaccctgggaggtgcttgcctcattcacctcagggagaggaaagcatcctcttccttgaagaagccccgccctccacggctaagcatccccagcagaccccactccctgagaccagcgtancccgccgaaggcctgctctttcacgaggctgnaggctgacgctgccctcgctctgacccaactgtttcctcgctatcttggccgcctctggacctatggcagcttcgatatccgctgggtccacgtcgtcaaaccagatgtcttccctaaaaggcaaagataacaggctgatcaccagaagaccctagtgcaactggtggggtggggctgtggggctgactgtgcaggtgagtggagcgatggcacagcctgcctctcccacaggctggccccagacaccccgactgctggccctgctgcttctgctattttgatcatcttggcattttccttttttttttgagatggagtctcactgggtcacccaacctggagtgcagtggcatgatcttggctcactgcaacctttgcctcccaggttcaagtgattctcttgtctcagcctccctagtagctgggattttacaggcgcccactgccacgcctggctaattttttgtattttcagtagatacggggtttcgtcatgttggccaggctggntcttgaactcctgacctcaagtgatccacctgcctcggcctcccaaagagctgggattacaggtgtgagtcacagcacctggcctcatctcttttctttttaattagaaaatacactcattattcaagatttaggaacacagacaaacacaaagaatataaaacagaaacacataacccaccacccaagtgtaatgagtgctaacattttaattatgaaggtaacacgttcattattgaacacttaggaaacagacagacagaatgcctgtaagatggaaacacagaaccccttgccctccgtactaggaagctcacacaggcacgtaacacctgcctggggaatctgtctcttgggctaaggttaaatgtcatttccttagaaaagccattcctggccccactgaatggacacgtccctcttgnttccaggcgcccaataccttctcctcactagatttatcctgaccacacttaatcaacagctgcagtttacagtctgtctactgcacttgacaataagcctcaagagggaggagcaggcccacctcactgaactctatcccagacagcctgcctagcacaacacagggaggcccccaaatggctcattcctcagccatcagcgactgtgtcctgaacacccaggcaacatgaagccagctgtaacttatgaacacgtcacctccagctgaaccattcagagaaggccactgactcccggtccaccccacgtgggtggccagcacagggtttattcttttcacttgtttttttgagagtcttgctccgtcacccgggctggaggcagtagtgcaatcacagctcactgcagcctcaacctcctgggatcaagtgatcctcccaccttggcctcccaanggagctgggnatcacaggcaacagccaccacacctggctccatcacagggttgaagtaatcaccaggcactgagccaagagtgccaacctcacaatctccttatgatgccaccatgactaccacaaggcacagaggacgtcagaaacttgccccaaaccacccaactggcgagaagcagggacaggcctcatacttgggtctttctggcttcagcacgctttccttccacacacgtgtactggcacccactaaatgctgagctctgctcaacgctcggaagaagcaggccctgccttatcatgcgcacactctaggggaaaacaagtaacagcgagtaaacaaaggaacagacgacatcagggtaaagtgatggagagactgcggtgaggccaccagccntccataaggagacaggccttggtgaagtcgctgtgcctcggttctcagtggtgaggtggcccatacttactcggtgggtggggctggggctgcctccttagctttccgcttcttatgctcgatgtcccctcgttctggaacaatatcaccatttgtcctttccttggttcctttcttattgtgctctgttccactggccttggtgcgaggtactggcgccctcctgtccatcttggaacctgaaggaacagagcccctgctggcctcctggtcttttcctgccggcatctcctctcccttcacttgaggcgaggtctcttttttgttttgctggataattttgggcttctttttggaacccatctgagagatgacaagaggcttttctggggcctgagatttttgtttcagcagccactgggacccaaaataaaatacatgctgcatttgaatttggaaattacacacagcagattgaaaaaacttacgtgtgtatgtatatacacacatatacaccaaacacatctatacaattcccatccgcatcactgaaattcattttcaaacggtttggaaaaagctctttttcattctcatgggtcacttgtggtgaaatgctgtttctttgcttatcttattataatgcattttgcacctgctccttcatgcatacaaaatgtcaaactcattctacaccttgggtacctgttgagtggctggacaccacagaccacttcccttttcagcttatctagaaagaattttggagttaacttccctcacagcttgggccaacatcctgctacacagaaatcgctttttttttttttacaagattccctggtttgctactgctgtgaagatctcaggaaggtggggggtgtcataaatgaaaagaaaagcttctgtcaaactggagtggctgaagaactgctagcagccacacaccttggctgtcacccaagcagaggctcctgtagtcttagagcccagcttcctccctgtgttcaaatccccagtgggagtgggcgccaccacagtgcgatgatgaggcgggtgctacttacctgttctgtgataggtaaagaactgaagggctgactttcttggatgaattagaaaacactccaaagtttccctatagcacacatcccttccattcacttattttgcttttctttcttgggagaaggaagaagagttggtgttcaagaaatcccacagaaccctggggctgcccacgggaatttgactggtcctgtgtgttaagacaggaatgtctgcactgagatactgtgcagagtattaggaggttcaagaagcgctcggggaggctgaggtgggaggattgcttgaggtcaggagttgaagaccagcctgggcaacaaagtgaaaccccatctgtattagttcattgtgcactgctataaaggaatacctgtgtttggtaatttataaagaaaaaacgtttatgtagctcatggttttgcaggttgtacaagaagcatggtgccagcatctgcttctggtgaggccgaaggaagcttcccatcatggtgtaaggtgaagggggagcaggtgtgttgcgtggtgagagagcaagcaaaaaaggtgctaggctctttttaaacaaccagctctcaaatgaaccagcagagtgagaacttactcgttactgaggggagggcaccaagtcattcatgagggatctacccccatgacccaatacctcctatgggccccatctccaccactggggatcacatttcttttttaaaaaaactactttttacttttatttagagatggaatctcaccatgttgcccaggctggacttgaactcctgagctcaagtgatcctcctgcctgggcctcccaaagtgctgggattacacgtgtgggctactcgggaggctgaggcaggagaatcactggagcccaggcagcagtgagctatgatcctaacaggaggtnagctccaagggagctccnaagggatgtggtaagaatgtatgagtgacgcacgtggaagagtgtctaggagagagcaggcaacctctacagaagtgcaggtcactagggagacagcaggtacaacacagccttaaaagcatggactccagagtcagccacctggttcccagccgcaatcttagatgatctatttaaacttttccagcctatttcctcatctgtacaatagcgatgatggaagtgtccacctcacagtcttattgtggggattgcaacacgcatggcatagagcacatggcagagtgcacatttttaggagctcaattagtatttacttcaagaccgtaagtgtcgctagaaccccatcacatgtctgctatctgcttttcacttctacacaggaatcttctttctcccntgtcttgctacacagaccagtgtgttctttcgttgttgttgtttgagatggagtctcgctctgtcgcccaggctggagtgcagtggcgcgatttcggcttactactgcctctgcctcccgggttcaagcgattcttctgcctcaggctccccgagtagctgcgactanccggcgcgcgccatcacgcccggctaatattttttgtacttttttagtagacacggggtttcaccatgttggccgggctggtcttgaactcttgacctcaggggatctgcccgcctcggcctcccaaagtgctgggatcacaggcgtgaggccccgcgcccggcctggtttcgggattttaagctaaatttctctttgtaaaatccattctagttagttcattatgcaaaaggtacaagggtttatctttgcttttttgtacttgaaataattctttcatcaatttctttcaagcaaacaagttcgagacctccctcaacaggccacctttcttgtgaaaagctgtttacaagatttcgattcaaatctgcctttacaggtcttttggggctacccaagtctttccctccgtcgcgttctgcgggaatgagctgcgcagcgctccgcccgggccccctcaagcctcacctcttgcagcgccttccagttttgagaaaagtcttctggtgcctttggaggtcgcaccacagcaccggggccgcttgctggcttcttgcttacttcccgcgccttgcttttccaaaacctttttttcttcttgtttttcttccgagtgagcgtcttgacaggacccggcttagccacggggctgctcggggcgcgcttggaggcggggaccttcgccttccccatcctgctgccgtccagcgcctgggccggcggccacccgagaccccggcctccccgggcccggcgccctggcagcacaagcgcctgcccaggccaggccgaaacacacccaccgcagggaccccgtccaggaaaagactccggaagagaccccgcacgcgttgcgcatacctcagcacgcacgctccagtccc

SEQ ID NO: 13269 - DNA, 2646 bp, Homo sapiens
gcaggctcctaccagcctctgggggccctggtcgggtctatatgcccccgatctggcccaaaatgagtctcccctgtgccgcccgccctgccaggtctgccgtggcccccggagctggtggaggtggtggtcacgaccatggagctacatgacagggtcctcgatgtccagctgtgtgcctgctccctgctgctgcacctcctgggccaaggtgggtgccaaaccaggccagatggggtcggggaggctgtgcgctgcttcctgcagctgtgcctcctgggccaaggtgggcaccgggccgggtgggttaggggaagccatgccctgctccctgctgctgcaccttctaggccatcttctaggccaaggtggatgccagggccaggccaggagacactcctggtggcctagctctgcccccaccacctggttggcatctaaccactggagagtccatgctatcctgtgcccatcagaccccatcctggatggcagagagggcacaggccaggagcttggagacgcggatcccacccaggcctgccttttgcctgctccgtggccctggacaagttcctgatgatcctgccagttttcccagctatgaagcgaggagctggacacgaggtcctctggagtcaccctcagggaggatgggttgtgtcctctgaagagggctggtaggagggcagtgctgagttcatttcactgtcctgatggaagaggttggagctgagagattgagcctcctatgagagacatgggttgttaaaagagttgaattagctttgatgattttttttgaaacaaaaagtatttagttacttttttttttttttttgagatggagttttgctcgtcacccaggcgagtgcagtggcgcactctcggctcaatgcaacctccacctcccaggttcaagcgattctcctgcctcagcctcctgaatagctgggactacaggcacccaccaccacgcctggctaatttttgtatttttagtagagacgggtttcaccatgttagtcaggctggtcttgaactcctgacatcgtgatccacccgcctcagcctcccaaagtgctgggattataggcatgagccaccgcgcgcggccacctttctagtttcactgttggaagtttggagttccatgcaatgttgaaattgtgttcagtgctgcctgactggctcccagggaccaggatgcgtggcctggccgggcagggctcccttccggtccttcactccattaggccacagggattcatggaggcctgctctgggtcagaacaaggcagacctcggtttccttcatgcaaagtggagatgctatcccccagcctgtgagccttgtgtgtctggccccatgcctgagctgtggggctaaccccaggcgtcttcctctggcttgagcagcgctggtgcaccacccggaagccaaggctccctgcaaccaagccatcacctccaccctgctgagtgctcttcagagccaccccgaggaggagccacttcttgtcatggtctacagcctgctagccatcaccacaacccagggtgtgtctgccagccacctcctgccccacccacgctccaggacagcccttcccaggggtcttggaagggttggtttggggtataggtgggttggacaggacagtgctgggcctcctcctgagatacatggtggcatttggccgtcttcatttggccaccccaaatgctggtcgcatccttttccatcttgatgacaagcttccactcttgaagtcactggttccctctacagacatgctaggcgcagctgtgggcttcacaccaatgacatctctttcccacacttcctgccccttctgggaggctggggctcaaatgccctgtgtgtctccattccatagggcccagtgggcttccgaagccgccagccaggactgtgggaaggagagggccatacagagcgctcacaccttcacccacaaatcgggtgggcactgttctccccaacaggaagctgggcctcgagagagcctaaggacagttgccaggagtccatgcagcagggttcagggctggggtctgggccccagcaccctctttactgcacagactggataactgatgatacatggctgatctcactttggggagtgaaaggaggcactaggaatagatgtcaactggaaccctcaggcaaaatggatgtcagttcatcctaccgggatagggccccgtcatggttccatcctggaaggcacaggctggctctgtgagcccaggaggcagggtcaggccccctggatgggaagctacagaggtcagacccagcctggtagtgggatggcagctattgggactggtggtccacgagatggacagactcctctggggccagtcccacatcctcctgttcagggctccattgagtgcacacgacttggcccagagcaggcacctaggattgcaggtcaaatgggactgcagtgcccaaggacaacagaggcaggaaggcttcctggagggaagggccctggggccctcattctggctcacccacagagtcagagtcactgtcagaggagctgcagaacgctgggctgctggagcacatcctggagcacctcaacagctccctcgaaagcaggg

SEQ ID NO: 13270 - DNA, 2659 bp, Homo sapiens
  misc_feature (7)..(7): n equals a,t,g, or c
  misc_feature (177)..(177): n equals a,t,g, or c
  misc_feature (780)..(780): n equals a,t,g, or c
  misc_feature (790)..(790): n equals a,t,g, or c
  misc_feature (867)..(867): n equals a,t,g, or c
  misc_feature (978)..(978): n equals a,t,g, or c
  misc_feature (1559)..(1559): n equals a,t,g, or c
  misc_feature (1815)..(1815): n equals a,t,g, or c
  misc_feature (2078)..(2078): n equals a,t,g, or c
  misc_feature (2223)..(2223): n equals a,t,g, or c
  misc_feature (2272)..(2272): n equals a,t,g, or c
  misc_feature (2293)..(2293): n equals a,t,g, or c
  misc_feature (2557)..(2557): n equals a,t,g, or c
gcaggcntcctaccagcctctgggggccctggtcgggtctatatgcccccgatctggcccaaaatgagtctcccctgtgccgcccgccctgccaggtctgccgtggcccccggagctggtggaggtggtggtcacgaccatggagctacatgacagggtcctcgatgtccagctgtngtgcctgctccctgctgctgcacctcctgggccaaggtgggtgccaaaccaggccagatggggtcggggaggctgtgcgctgcttcctgcagctgtgcctcctgggccaaggtgggcaccgggccgggtgggttaggggaagccatgccctgctccctgctgctgcaccttctaggccatcttctaggccaaggtggatgccagggccaggccaggagacactcctggtggcctagctctgcccccaccacctggttggcatctaaccactggagagtccatgccatcctgtgcccatcagaccccatcctggatggcagagagggcacaggccaggagcttggagacgcggatcccacccaggcctgccttttgcctgctccgtggccctggacaagttcctgatgatcctgccagttttcccagctatgaagcgaggagctggacacgaggtcctctggagtgaccctcagggaggatgggttgtgtcctctgaagagggctggtaggagggcagtgctgagttcatttcactgtcctgatggaagaggttggagctgagagattgagcctcctatgagagacatgggttgttaaaagagnttgaattagnctttgatgattttttttgaaacaaaaagtatttagttacttttttttttttttttgagatggagttttgctcgtcancccaggcgagtgcagtggcgcactctcggctcaatgcaacctccacctcccaggttcaagcgattctcctgcctcagcctcctgaatagctgggactacaggcacccaccnaccacgcctggctaatttttgtatttttagtagagacgggtttcaccatgttagtcaggctggtcttgaactcctgacatcgtgatccacccgcctcagcctcccaaagtgctgggattataggcatgagccaccgcgcgcggccacctttctagtttcactgttggaagtttggagttccatgcaatgttgaaattgtgttcagtgctgcctgactggctcccagggaccaggatgcgtggcctggccgggcagggctcccttccggtccttcactccattaggccacagggattcatggaggcctgctctgggtcagaacaaggcagacctcggtttccttcatgcaaagtggagatgctatcccccagcctgtgagccttgtgtgtctggccccatgcctgagctgtggggctaaccccaggcgtcttcctctggcttgagcagcgctggtgcaccacccggaagccaaggctccctgcaaccaagccatcacctccaccctgctgagtgctcttcagagccaccccgaggaggagccacttcttgtcatggtctacagcctgctagccatcaccacnaacccagggtgtgtctgccagccacctcctgccccacccacgctccaggacagcccttcccaggggtcttggaagggttggtttggggtataggtgggttggacaggacagtgctgggcctcctcctgagatacatggtggcatttggctgtcttcatttggccaccccaaatgctggtcgcatccttttccatcttgatgacaagcttccactcttgaagtcactggttccctctacagacatgctaggcgcagntgttgggcttcacaccaatgacatctctttcccacacttcctgccccttctgggaggctggggctcaaatgccctgtgtgtctccattccatagggcccagtgggtttccgaagcctccagccaggactgtgggaaggagagggccatacagagcgctcacaccttcacccacaaatcgggtgggcactgttctccccaacaggaagctgggcctcgagagagcctaaggacagttgccaggagtccatgcagcagggttcangggctggggtctgggccccagcaccctctttactgcacagactggataactgatgatacatggctgatctcactttggggagtgaaaggaggcactaggaatagatgtcaactggaaccctcaggcaaaatggatgtcagttcantcctaccgggatagggccccgtcatggttccatcctggaaggcacaggnctggctctgtgagcccagganggcagggtcaggccccctggatgggaagctacagaggtcagacccagcctggtagtgggatggcagctattgggactggtggcccacgagatggacagactcctctggggccagtcccacatcctcctgttcagggctccattgagtgcacacgacttggcccagagcaggcacctaggattgcaggtcaaatgggactgcagtgcccaaggacaacagaggcaggaaggcttcctggagggaggggccctggggccctcattnctggctcacccacagagtcagagtcactgtcagaggagctgcagaatgctgggctgctggagcacatcctggagcacctcaacagctccctcaaaagcaggg

SEQ ID NO: 13271 - DNA, 11242 bp, Homo sapiens
aggatttatcatctgtttcctttaaggagggtgcaaagttgttctaacagtttccgttacaagggtacaaactggccgctccccccaatagacggttttgttgagttcgcctctttttttttcttctttttttggccccacttcctatgagagaaactgcttgggtgagggaggtgaaaggagccctggagggtgttctctgaggttttcttcaccatcctcattagccacctgaggtggggctgaggactaaagtaggacagaaggtctctggtagatagaggaggggaaaatcagggggatcccccactttcttcacacccaggacgcagggtgccgctgccggccacagaaaccccaagaatgtttttctttggctattcagaggacatctattgtgtgtcaggccctgtgctgagctgttgttgcctgacagcaggaagagcgcggctctggtttctgtgaagaggctgcgggtcagcctccgactacaagagcctcggcccacaccgggaactcagtgaacgtcagcgggagctggggcaagagcactgactctgagacagcagcctccgctcactatttgaaggcggggtggcggggggccttgaaggagagcgaagtgcgagagaactcttcaggtgtcaccaaggtgggaaggtgctacgaggcgaggcgccgagcggcgacccccatcccgctcgcccggagtcaacatggccgccgcgcagggaggcggggctgctccaagtccgggcaggagcggggcggggacgccgtcggcggagccagcgcgcaggcgcgggccgcgtgggccccggatggaggagctgaggttcggtccccgccggggaggtcgggacgggcaggggctgaggaccccgcgccagcttgggagccctggagttctggcgggagggaagctgtcaaatggaagccggtagaaatgagacagacgcccggagaagcggggagccccgcccctccgccatagcagcctcgggcgccgcctcttcctttccagcctcccgccctcgtctgcttccggccctgtggcctggtggggctctgcaggctccctcgggagtggtccttgggccgtggcccctctggggtgagcgtggatgattagtacccagaagggactgtgtccaaaaggagccggccagaaacgggttgcggacacggctgggctgacagaaggcagcccccacgaggcctttggctctgaggaccctgggtcagagcgacttctccagcctgcgcagggggtgttagtcttacccagagggtccagagctgccgttcaacaggatgtcccagattctcagatagggcccaactaccctaagcatacctagcaagggcaggctgcggcatggaagtactgggctaggcgtttgggtgacctgggtcataatcctggctcggaaagggcgcgtaccctttggcgagggatgcgggctggtaccgtgaggtttaagaagcagaaaacatgacagcctctttaagtagccctgggtacgtcacttgaccccagtgagcctcagtttccatatccataaaatggcgatggtaattatactagcctcacagtgtctgatgagatctctggagcctatttatctcacgggaaaatttttgaagagtgaaactagttgatctgtaagtgtcctgccagttaagagtctgtgatttggcaaaggggttgttgggaagtgaggtgggcaattagctgagagggagaattgactagctttgtttttacttggtttacctgtaagcaaagtgtgggctacacacatctgtagtcgctgaggctagagcttgactcgagagaggaaaggaagaatgcaagcatggtcaagtggcagaggtgggttaggtgcttttctgatcccagcttctcttctgcatgcgcgtgggaagccaaggaagaggaaaaaagagtgaattcgccctaggatagggaaggagtagccgcgtgaggttgagtatgcccatttccgtgatttctctcgattcagcgagtcatacgttggaaacgtttagattcacaaactatcgttactgtctggggctttcagaagcttgcctttgaaccgaattttcgtgagccaaccggtgtggaattgggggcccctcccttcctccaggcctcctggcgatggagtaagcagcaggcgcccccttgtgccaaggaaagagtactgttgccattggccaacttggctccctttctggggaaattttattttcctgtggcttctgtgactttgtcgtcttgctcttgacatgagatatgatgggaagaatacttggggcactgatttcatatctagagtcagtgaactgctgatgctgtatcctgtccctaccacttccattcattcagaacacaggtttaagatgcctatttgtgttctaggccctgggatatagttgtgatgtaaagcccctgcccttagcaacttaaataagcaatagcaataacggcaatagggcagaatgtaatgagggcatagcacactgtctagtgaggatcagagaattccagaaacaagtgatacaggttttttaggtattcgccagataagagaagaaaaagagtcttccagccgtcctccttaaatttctcagttcaaattttttttttccttttaggcatagttcttcatcccaaattgatgagctgcctctgatgcttttgctttcctttcaaatttcccaggctggtgtttgaaagttcttgaggagcctttatgactccttttagctcaaggaattataaaagatgccttaaggtgcattccctgcctcggagtggctttgcgattgtttatacgttgctaccatcccaacaaagagatggcaaataacagttttctccatccctggtagtctactctgtcttcaccctcagtttgtttcagcagtgtgagctggctgaggtcctgctgagtggtggttttcttttccttccccacttaatttaacagaccagctgaacacacatcagagagctaagctagagtgtggagtcattatggtcttctagtatggttttatgccccactttggggactctggtttgggacctagtttattattctgggcaagaggaaaagggcacacgccaaataatagcaaccacaacacagatttgagtagaacttcacactttggtctgtttcaccatcatgacaattttgtgagataggaaaaaaaaaaagtctgctcccattttttatataaagaactgaggctcagagggactaatgagaacttgtaagtgacagagtcaggagttgaacccagatctttagttcctgcagaagtgcatccaataggctttaaaagatttctgtgaccttagctttccagctacttgcttagctgtatggaactttaccaacgacagttcagggcttcacagtgacacctactgaacccatttgctgtcaagatgctttcccctcatctgggaagttaggtggttggttaagtttgtcatagtaattctgagaggggaggttccagtgacgaatgctttcaagaatttgctttcactcgatgtgtgacattttcctcctttggggtttagaggcctgagggagctcaatcctggtagcaacacccctgaattcctggtggtgaaaggatgtggccccaggacccatcccggaaggaggtgctgaggtttgcagtcagctgccgtatcctgactctgatgctgcaggtcagtctcccatcctttgtcctgaatgtgctattgctacatgactggactaggcagtaagaagtgtccccatctcctttccacctctcaggtgtgcccctccatgtggttggaaccacagagacatagactttagagctgaaaagttgtcaggaatcttagaaacacggtctgttgatcttgttttacccatgaagcagcagaggcccagaaaggttaagtgacatccccaaagccacatagcaagatagagaagggctggagtttgaccccatgtttcctaactcctgagctagtggtctctccaacagactgtgatgttccgtaaccagagatgcttatagggtgggacagctcaaagtattgccctgtgtccccttactaggagactgagcattgtgtcagttgagtgggagaaacgtggcaatgtgcaagtcctaaaaccatctggatatgtaatagttcctcctattcccccgagtgcctgcccttcctgcctcacccacacacaactctcagtgcacttgcccgtttgcagctcccttttccctccgaggctccccttgatacacattttaataaaatatcacgtatatatgaattatttgctgcctagcacagtgcttggtgcctagctcagtatgttcataaatgaatgaatgttgttgaatgtatgtcaacaccctagggatgttagattcacataatgatgtgtaccttttatccctgtaccattctctctgaggctcataactggtccctttgtggaaactttcctctctcctttcccactacataaggcatggcagactctgctgggtttcgagattagttaaacgtgtccacctgcaggctagggctgtttatctgtgactgtcactcctatcctgtttgtttttactgtttgaagtggcctgataaggaaactgaccaaaaagttaaaaagccttaaaaatggtgctatgctcctgttgccaggctagggagacttactcagtgatgtctctcaaccagcatcagctgggttactggcagaaccaaaggagcaatgctgcaagtcagcatccaggatagggaaccaggacagctgggctctaattcgggtggtaattttggaaacagtatatttcctctaggcagttcattcaaccaccaaaaatttttaaagtacctattgcgttccaagaactgtgctaggtggtaagtgtaaaaagacatggtctcttttctcttaagtagctgatgatctaatagggcaaaaagactttttttttttgagacagagtctcgccctgtccccccaggctggagtgcaaaggcgcgatcttggctcactgtaacctctgcctcccaggtttaaatgattctccctcctcaggctctgaagtagctgaggcgcccgccaccacacccagctaatttttgtattttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagaccgggtttcaccttgctggccaggctggtctcgaactcctgacctcgtgatctgcctgcctcggcctcccaaagtgctgggattacaggcgtgagccaccgcgcccggccagcaaaaagaaatctaacagtaaatgcgatttaattatcatccccccacttccaatgctcaagccatcagagtatatccctaagttacccttcgttgctgctgtcgtctctgtcagtgacagctaatccttgacggttttggctcctggttcactgtcactcttcccagcactacttctattgatttcctggtgatttcattattaatgaagatgatgtgtgcagtgtcctgaaaagagtctatcacttgagtgtgagttctggggaaagggtgttagagatttgaggaaagagaaaaacatgtaacatgtaacaaattgttttcctaaatgacaactcagaacaatagaaggcattagaagagaccttccatatgcgcccatcacattcttcagcctacctatgtctgcacctttgtgctttcagtactgaaggttggatgaaccgtctgtcctcttctctaaggctggctcctctacctttgtaccctttttgcctacccagcaattctcccctctctcctgcatacccttttactgggttatttccactagcatacaaacctttacctcccaccttaaaaaaagttttcactttaccccacattgttgttcacctactgccccatttttctgcttccccttatggcaaaactcctcaaagtttcttttctcccattctctgttgaacccagtctaggtagacttctctctcttccactccattgaaatagcccttgtcaaagtcaccagttactttcacattgttaaatccagtggtcagttttcagcccccatcttacttgacctaccagcagcatttaacagagttgatcactccttttcttcccttggttctaatgctctcttgggttccctgccacctcactgactgttcctttttttctttattgctggattttcatcctctttctagccttcagatgttaacatgtccagggttcagtcctcaagaagagttctaagtgtttttgaaacagggtctcatgctgtcacccaggctggaatacagtggcacaatcatgtctcactgcagcctcaacctcctgggctcaagcaatcctcccatctcagcccccccaagtagctgggactacaggcatgtgccaccacacccagctaatttttatttttttatttctagtagagacaaggtcttgctacgttgcccaggctggtcttaaactcctcggctcaagtgatccttccacctcagcctcccaaagtgccgggataacaggcgtgagccactgtgctcagacttttttttttagtttttatagagacaaggtcttgctatgttgcccaggctggtcatggactcctgggttcaagtaatcctcccatctcagcctgccaaagtggggattacaggcatgagcctggccttcttcctcattttattaaatggcaattcttttcttccagttactcaaccaaaattctggtttttctttactccacaggccctcttcaatgccatcatcccagatcaccatgcagaagccttctctcctcctcgcctggccccctcaggctttgtggaccaactcgtggaaggtcttctgggcggcctgtctcactgggatgctgaacacttcttgttcattgctgagcatggctacctgtatgagcacaactttgccttctttcctggtttccccttggccctgctggtggggactgaactgttgagacccttacgggggttactgagtctacgcagttgcctgctgatttcggtagcatcactcaatttcttgttcttcatgttggctgcagttgcacttcatgacctgggttgtctggttttgcactgtccccaccagtccttttatgcagctctgcttttctgtctcagccctgccaatgtcttcctggcagctggttactcagaagctttgtttgccctcctgacattcagtgccatggggcagctggagaggggccgagtctggactagtgtactcctctttgcctttgccactggggtacgctccaacgggctggtcagtgttggcttcctcatgcattctcaatgccaaggctttttctcttctctaacgatgctgaatcctctgagacagctctttaagctgatggcctctctgtttctgtcggtgttcacacttggccttccctttgccctctttcagtattatgcctacacccaattctgtctgccaggctcagcccgccccattcctgagcctttggtacagttagctgtagacaagggctaccggattgcagagggaaatgaaccgccttggtgcttctgggatgttccactaatatacagctatatccaggatgtctactggaatgttggctttttgaaatactatgagctcaagcaggtgcccaattttctactggctgcaccagtggctatactggttgcctgggcaacttggacatacgtgaccactcacccttggctctgccttacacttgggctgcaaaggagcaagaacaataagaccctagagaagcccgatcttggattcctcagtcctcaggtgtttgtgtacgtggtccacgctgcagtgctgctgctgtttggaggtctgtgcatgcatgttcaggtgaggtggattcctgactgggataaggatgtgaatacaggcaaaaccccttggccaaggacagggaaggcagctaacatctcccgtttgagtgatccatactgaatttattcattcaatgactatttagggttattctttatgccagactctgggtcagacctctaaggatgaaacataaataagacaaaattgcggccaggcgcggtggctcacacccataatcccagcaatttgggaggctgaggtgggtggatcacaaggtcaggggttcaagaccagcgtggccaagatgttgaaaccttgtctctactgaaaatacaaaaattagccgggcgtggtggcaggcacctgtaatcccagctactcagaaggctgaggcagaaaattgcttgaacccgggaggtggaggttgcagtgagctgacattgcaccactgcactccagcctgggcgacagagtgagactctatctcaaaaaaaaaaaaaaaaaaaaaaaaaattactgccttggggggtctcatggtataaataggaggacagacatttgacataaattatagtacagtgggatagaaaagggagtgctattttgagatttattttattttactttatttatttatttatttatttatttttttagatggagtctcgctctgttgcccaggctggagtgcagtggtgcgatctcagctcactgcaacctgtgtctcctgggttcaagcgactcttctgcctcaatctcccgagtagctggaattccaggcgcctgccaccaccgcctagctaatttttgtatttttagtagagatggggtttcaccacgttggccaggctggtctcgaaatcctgacctcaagtgatctgcccgcctcatcctcctaaagtgctgggattacaggcgtgagctaccacgctcggcctgagattttttttttttttttttttttgagacggagtcttgctctgtcacccaggctggaatgcagtggcatgatctcagctcactgcaagctccacctcccaggttcacgccattctcctgcctcagcctcccgagtagctgggactacaggcacctgccaccatgcctggctaattttttgtatttttagtagagacgggatttcaccgtgtgagccaggatggtctggatctcctgacctcgtgatccacccgccttggcctcccaaagtgttgggattataggcacgagccactgcgcccagcaagatttttttttttaaagctcagataaagtattatggaggcgaagaagtaggtaactcactggagtacttgagaaaggcatcatatttcagctgggtcctgaagaatgagattttccatataagaagcagaggaggaacattctaggtaaaaggaagggcatatgcaaaaacacgagggttgtgaaaggacctgattggactgagatacaggaataagcacggaggatatctctgggatctttttccctaatacacagttatagttatatccatattggtttcttgactgttgacttcaggaggttctcaactcaggcaggcccccaatttccagaggagataaccttaaccaatgttttgggtggtggcggtggtgatagagagggatgggaaaggtttgatcttatatctgattttctgttcttggctgtggccccaccctggggacatcttttttccccatgccgacctcttagcagtttcttcctgttggagttgcacattggctgtttctaaaattctccaagctgtatggataagagacacagaggaaatagaaagtagcattccgtgtttttagctagattaaatcgtagaatgtgtgccagcaaagcttaaagtttccaggttagctgagggaggccatttggaaacttgtgtctgaactccaataggagagagaatgttcaagcaatgggtcttctgcccatttccctctgctttgccatcccatgggataagggaaccacctcaggttcccaatccccaaatcaatatcacagagtttagagtccaggccctcggctaaaattagaccccatagagtttctagtattaattggcccattattttaatagtaattaatgtaattagtctgtagctatgtttatttgtaatatggaggatgcctgtctgctgtacatacatctttctaagacagatcctaagctgtgttcaatttcttttccagtgtaatacatttctagtcacaggaccatagttcacccagcagtagagaagtccccgggctggtccaatttgagtcagtgacattccagtaaatgtctggatattcccctctcatgatttctaggttctcaccaggtttttgggctcctccactcctattatgtactggtttccagctcacttgcttcaggatcaagagccgctgttgagatccttaaagactgtgccttggaagcctcttgcagaggactccccaccaggacaaaaggtccccagaaatcctatcatgggacttttgtatcactggaaaacctgttctccagtcacacgatacattctaggctacttcctgacttactggctcctgggactactcctacattgcaacttcctgccttggacatgacctggactctccagggacaggttggaagccaacttaacccaggggtctgaaagtaaaaatacacattggaactgcctctgctgccctgggatcattactgtgtccattataatctttctctttctctttgaaagctggtcaggaatgggagaagtgtcagacactagagagccccttctggtcctggctagggcaaattttagacaactattttctctgtaagtgaagattgtcgtattccaagtctaaaatacacctggatctgtctagtcaatcaacatagcagagacagtcttaaacctaccattgacctgtgtgtaaatttaaatgtcaatttattgaagtgtaaatttcatcaaaggcattagctgacaggctggtaacagtccacacaagatggtataggcctgaacagtgtagtggcagtaataaagtgggaccattttttccaaatgcgacattgtttctgatgtttttttttatgatttgtgcatgtatttttatatgaaaaaaacttacaaagatatgcaaattaaacttctttcagttata

SEQ ID NO: 13272 - DNA, 276 bp, Homo sapiens
cacacctgtaatcctactcgggaggctgaggcatgagaattgcttgaacttggaaggcggaggtttcagtgagctgagtttgcgccactgcgctccagcctgggcaacagagtgaggctctgtctcaaaaaaagtaaaaaataaaaataatacaaatctttccatgtggcaaaaagtaaaataattttaaaaagttaaaataatataaatcagctgggggaaaaaagggtaagaagaaggcatcaggaaccctggattctagtcctctcagtaaaa

SEQ ID NO: 13273 - DNA, 319 bp, Homo sapiens
agctgttaagacttggtgtgcccatcttagcatagcccgtaaagactcttacatatgggaaaaatggaagagagggaaagaggtaaatctgtgaaagattaaaatagtgtagagtgggagaaccagcctgggaggctggagacctgaattcaagtcccatcgctaccactagctatgtgacttcttgccagtcacttaccctttgtgatccttagctccctcatccataaaatataggtataggattaaagaaattgatttattgaccagatctttattgaagacacacagtgtgcaaggcactgttctaactggaaat

SEQ ID NO: 13274 - DNA, 8864 bp, Homo sapiens
gggctatggggaagccatccctgcttttcttcggtttgatggcctcgtggagaacaagaagccaagcaagaaggacgtggtcaacctcctcaaggatgcctggaaggaacgtcttgctgaggagcaggtcagatctcaccagccactctggcccagcatggtcttcagatccagagtcctctgcaggtccagaggtgacagggatgagggccaaccaaccgtaagactctgactgagcatttcctcgatcccgcagaaagagacgttcccagatttcttcttcaatttcctggagcatcgctttgggcccagtgatgccatggcctgggcttatactatttttgaaaatatcaagatcttccactccaacgaggttatgagtcagttctatgcagtcttgatgggaaaggtgagctggggcctattccccttggggagactgagaggggtctttgtccctagcatagaccagctttgcccccaccactcccaggaacagcaggtgaataatgcttctctccttatagcggagtgagaatgtgtatgtcacccagaaggagacagtagcccagctgctgaaggagatgacaaatgctgacagtcagaacgaggggctactaaccatggagcagttcaagtgagaggccagtccaggctacccccaactcctacccaactattcctgcatctgtagggaaaaggggcacctggtgggaagggccacagcctcggcactcactcccttttgagcactagggagaggcacaagcaggcctcagcaggtccctgttggccctcatgtctcccctacagcactgtcctcaagagtaccttccctctcaagacagaagagcaaatccaggagctgatggaggcagggggctggcatcccagcagcagcaatgcagacttgctcaactaccgctcactgtttatggaggtgggtgtgtggggtccggggactggcctggcccctgccctagccttggctggaccctacccaatgtgccctccccctgacttgtggcccctcccaggatgaggagggccagagtgagccctttgtgcaaaaactctgggaacaatacatggatgagaaggacgagtacttacagcagctaaagcaggagcttggcatagaactgtgagtgaccctcatccataggcgagtcccacaggctgggcccctgaagcccctgggtctccctgtgcaccatgcaccatccactgctcagcccagcacagaggagggcacctgggagtctggggcacggagaggaggggtcagggcctgtcactctctttcctgtggggcagccatgaggaagtgactctgcccaagctgcgagggggcctgatgaccatcgaccccagcctggacaagcagacagtgaacacctacatgagccaggccttccagctccctgagtcggaaatgccagaggagggtgacgagaaggaagaagccgtggtggaaatcctccagactgccctggagcggcttcaggtgattgacatcaggcgtgtgggacctcgagagccagagcctgcaagctaggaacttgtgggcagcctgcgtactccagtcctgctaacccctagcttttaatataaaagtgtttgtctgaatccatgccattctccagactgtgctggggagttgtgggggggaatcagtccctgcctggctggccccaggacatgcaccaaaatgcagaatattctgtttatgacactttattgatgctgggggggtggggaggagacctggagaaatatgtgggggcaagagtccccaggtggggacagggaaagtgttgaagcctggccactactgggcagggaagacagagttgccactgtatgcacaggggatgagcagctgccggtactccaggggcaggtgccgctccactagcacgtgcagtgagacttggtcagtgaccaggccctgcctgcagtggaggaagagaagggacaggcagaatcagcaccaaaactcccccagccagcacccccacaccttccgccttctcaccgccgcatcagcagctccaggtcctctggcttcacagtcttgcggccagcatgagcagcaaatacctccagatcatcacaaagatgctggaaatatttatctaggctgtcaagaaggtggggatagagcaggctgaacagtctgatcatgacccgaggggttcctctccctaccccatgtgcccaggactcaccacttctccaccatctcaagagccttcctctccatgggcatcttggcatagaagctaaagagtttcacatagtggctcagtccagccttgtggggatcttgccggggcctggggccggtggtccggggcctagggggatgcctgaccaacagaggctctgcaggctctgaagataagctgagggcaacagtggacagagggggctgaacttgcctcaaggaggctcttattcaagagcaagtcttgctggcttctgctgaggctggggaccacgtggcccttggccagccaggaccagcagccctgaccacctgctgaggggcagttgggtcagggggccacatagaggccagtctttccctggggctctgtccctccacagtcgactcgacatcctggttcagacttattatctatattggtacctgcttgggtccatgactccaggccttagaatggatagtctctctccttactctactgctgcctttcccgattctgctaatcgtcttccaggaagccttttctgactacaaaccaaccacatactttcccctcacccaggctcctctaagccgtggaggcaggcaccaggatggcaggggtgctcttggtgagctctccccagcccagctgaagctgccctgctgggtaatcatctgcatacccgtaggaagggggaggaccctatgtacacagcatacccaatgctcccttcccaagaggcccatgaggaatggggttgtgggatcttacactgcagcaccaggcgctggggctggctcaagaaactgatgatgtcgcctggcctggagagactcaggggtgctggaggccgactctggacttgctacaaagaagaagggtggggtcacagggattccaggcctgaccatctcacccaggccagcacagccacagtatttctgtcctgtttctggtgggccccacctagctccagccaagcaggtgcccctcagtgtctccctgaccccctaccaccaccagtgcccggaaacacaacccagacaaggcctttctgtgtgctagggcctgaacacagctgtcaccagtcactccctgcactgggcctcttacctgccctgccagaggcatcctcatcccctgaagatgctcctggcccgtcagcctcagcagtcccctgggatccctctgcttctgtcacctctgtgtgtccctcagcctcttctaccctgctgggtccttgtgctcctgttgcctccatttcactcacactcacaccttcttcttccatctttttctctgcctcttcaactccatcgtgtaagggctctacttcatcttctccagagacaccactgctggtgctcaggaagcccagagcaaaggcattgacctcctctgcctctcctgccagaaactgggctggtttcccagggcctgagtgaaggggagagaatacaggccggagacgcagcaggccaaggctgcatagctcagagaagggtaaagatggaccagcagacccagtcctgcccactgaggaaagacaaagccagaggcagcaccaggacatggatctgaagtctcctggcccaacatggactctgctcttggatgaaggaggcagccacagccagggtgctctaggggcacagaggggcttgaggaaggaaaactaccattgtcaactctcacccaagctaaatttggctccaggccaccagtgccacacactcactattcttctgcagcccaggcccactgctctgtgtcttgcgaccggcagcctgctcagcgtcttcagccccagtgtgaggcgtgcagggcagggagtgatacacgttgggggagccaaccatgggctgagagaacggctgggtgtcctccaacacaatgtctgtgggcagagtagtaacaggttctgaggctgtcacctggagatcaggggccagctggctctcagcgtattccaggcccaccggctgctactcagcgttgccagggcctggacagtgggctgcatgggtccaccctgagtggccttcagagaaagaagacgacctagcacgcgaggccttatcgcctacagccctccttgcttaccttcctgttcctctgcctggcagtcccaggcccctatagctgcccgcccaccagctgcccacttaaaatacctcttcgctgcttgttctgctccgtcttcccaaaccctcttcttactctggtgaacttgttttctgcaatcaggctcccaggtcagtttgaattggccagctgatcctgaaacctggcccctctcaacaagttttggccaccacaccacacccctttacaacctccagccctatagtctaaggatatggggccctgggagacaccgagggaccaaggaaagaggccccctgtagaaagcaagcagaaattccttgtagacccactgaccagagttgctcgctgtccttgaccccaccgagaggggtgcaaccctgactcagcatcacctcctatctgtcatagcggggagagctttccccaaaggccagcaggggaaaacccaaccttacttggaggagccagggaagtatctcgcagatcccgcaaaaaggcacccacgtctacagctcggcgggctggaggtctgcgggccaagccaggcctctgcactgactgtggctgaagaggtgtggcaaaggtcaggttgagggatctggtgaggtggggaggcacagaggaaagtcaggtacctgagacccagtttgcccacagatccctccatctgccctggggctctcatctcttagaacagatgctgtgaggctaaaactggtaggaagtagtatgggcagattccatcccaggcagcacctccctccccaagtctctcctccacccactcccagaacaggaaacacccagagcagcacctggtgagggaagaggcatcagcattcccttgaggctctgtcagcaaccggcaagagaatgtaaaagaagaaaaccatggtaagtgatccaggcctgtgagggccctctctcaggactcctcagcctctccagaggacaggagggagagggtagcaaaagtggtgtccagggcctcaccttgggagagagacagcccctggtccactccctgctgaaacactgacagtctcagcctctgtttcctcctgccaggggccagcagacctggagccagggttgtggggggctcgagctcaggaagttgcagctccaggctataagaatggagcttatctcagacaggccaggaagtccaattctggcttttgcaacccccaagaaactcccggactaagctgcccatagcacaatccaaggtgggggagttctgtgtacctgccgcaactgctctcttgtctggagggttggaccgcctgcggtgctggcactggcttcactaccgactcaggcatcaggatggaagattctggggctgcagaaacaccaaggagagggtggggctgacagaacaggccaccctgaataaaagataccacaagactggggttggactggtacctaactctgaccggcaggccagcgctcacttaccagttagtaggatgttcttcagcagcgtccgaggtgtctgttcctccaagtgcccactggcctgaatatgggccgatctgccaacagactatcggcaaagcaccaagcaaccagtctgtccgtctgccttgagatttcctcaaggtgggctccagagcagagctagacctcaacccccctccccgaggcagccagggccctttggggtcagtgggctgggtacttatccctggctccatgggaacgccctctggctatcgtccttgtttggccactcaacttcctgggggaagccgtttcaagcagggctctccgggctctgtgtaaagaccagcaattatgccgagaattacggtgaggagggatagagaatatagagacatgccttcatcaggggtcttggtctggagccgttttccctcagggctagggacccagaaaccacttgcccctaccatcgcccctgttcccagccctatgtcaccagcagtgtggaccgaagaagacccctggggtatgggaatagagagggcatatgagtgaaccaaccaggaggggctgggaaaggcttcacagaggtgacttcagcagaatcacaaaggataagtaggggttagccacacagaaaagaggggcaattggaaaagcatccaccccagacatgaaagtaacaatccatgatggatactaaagtattttaaaatcttttaagaacttgggtaccccagacaccttagtctctccagtccagtccctctcagattccagagccacataagtgttcccagggcgcagctcctacctcatgggtgtaaaacctataatgaatggcttctcattccctataaagaaactccactgtcccagtctggcagatgtcaacgtatgcatcctctgcaccatgagctcaccacagccctcacccactgccactcccactgactcaggccaaattccctgctccttagcaaagcatcttccagttgctgcctcccaacttctgcccaggctgtcctctagctcctttcccatttcccagctgggagctacaaggacagtaagacaatgagcaggaacagtgggaaccctcgggacgcagaagttcagggcaaatgcctaggcacaccctggctggtctggggaaagctgcctagagaacagagcagaaggtgagattctgaacccctatcctccatctccagtggccgagcccccagagacccgggatcagtcaggctctgtggtcccgagggctggctgcctggagccctgggggcaggggcacaaacagctggcccgggcccggctagagcaatggaaccagttctcagagtcccaggccctgctcctctctgagactcagttttcctcttcgaacagagtcgacgctgggttccacccagaccctgctcctctctgagactcagttttcctcttcgaacagagtcgacgctgggttccacccagaccccactccccggtccctctagttgctcaagtactcggggagccccctcacatacccagcccgagcactccggggtcgccgcggggtgcgcgggtccgctgtatccagcacgcgtcgcagcagcgtgcgcggcgtggagtcgctgtcagggttgtggtcagccatcgtctcggccccgggccctcctaaccgcccagccagctgcaggctccgccttcccgccgccacagttaatgtaactctcgcgatgctcccgcacagccccacgggaattgtagttctcgcactatcgcagctcgcggggtggacagtgatggttgcaaactccggatgctttggaggcagcctcgctgcgggtaaacctcggttaatgtaatgcaagcagcccaagtcttggcttcttcatctgtaaattgaggttgatacccacctgataaggagcttgtaatgattcaaggagttgatgtttaactcagagtctaacacacgataagccagggcactggtaactagcaattgctattattagaaggctctctcattcccatctccctctccgaagatgaggagagacacttgggccaggaaaaagatttttatcctacatatgacctggttagatttgcatttgcaggctaggcggtggttcacgcctgtaattccaatactttaggacaccgaggcgggaggatagcttgagctcaggagttcgagagcagcctgggcaacacagtgagacccctgccccctggtctctacaaaaaataaaaataaattattcagtcatggtggtgcgcgcctgtagtcccagataatggggaggctgaggcaggagcattgcttgagcccaggagttcaagacttaagtgagtcgtgatcgcactccagcctgggcaacagagagagaccctgtatcaaaaaataataaaagcatttttaaaagatctgctttgcaaatctgtctatagggcctatctctatcagaagagacccaggaagcaggctccaaggctaataggctgtttgtgatccagcactgatgttattatgatctccaaacacgagcaattttgagatgaattccggctctcaaaagttctattaatgttttccccattaccaccacatctagcaaaataaataaataaaaattggggttttttttgagacagagttttgctcttgttgcccaggctggagtgcaatggcacaatctcggctcaccgcaacctccacctcctgggttcaagcgattctcctgcctcagcctcccgagtagctgggattacaggcatgcaccaccacacccggctaattttgtattttaagtagagacagggtttctccatgttggtcaggctggtgtcaaactcctgacctcaagtgatccgcctgcctcggcctcccaaagtgctgggattacaggtgtgagccactgcgcccggccattaaaaatttttaatgctagagatgcttaccatattctgttagtgttttcctccgtatttttcactggttgacaatcctctcaccttaagttttcatggcaactgaattagaacttggtttctgagtcttccgtggagttcactttcccagaatct

SEQ ID NO: 13275 - DNA, 483 bp, Homo sapiens
ttggagatgtggtccccaggagggactttgaaatgcaggagaagaccaacaaggatcttcaggagcaggtgctggcaggcaggcagggccaggagggtaggacggggtctcacaggtggggggccagggccaatgtccttgcccacagctggacaccctgagagccagctacgaggaggttcgcaaggagcatgagatcctcatgcagctgcacatgagcacgctgaaggaacgggaccaattcttctctgagctgcaggagatccagcgcacttccacgccgcggcctgactggaccaagtgcaaaggtgagggcagccggcagggccccaggtcctgcttacatgtgggcccagactccagctccctctccccacatgcagatgtggtggctgggggcccagagcgctggcagatgctggctgagggcaagaacagcgaccagctggtggacgtgctcctggaagagattggttcggggct

SEQ ID NO: 13276 - DNA, 109 bp, Homo sapiens
gtatttttagtagagacggggtttcaccatgttggccaagatggtcttgacctcctgacctcatgatccgcccacctcagcctcccaaagtgctgggattacaggcgtg

SEQ ID NO: 13277 - DNA, 14260 bp, Homo sapiens
caactcagatccggccccggtccccgtccccttccctcccccctgccctaagccacctccacctctgtcctggccgcctcagggcaccctgaaaggatcaggacatgcggctgcgcttttggctcctcatttggctcctgctgggatttatcagccatcagcccacccctgtgagtagacgctggacccgcggggtttcttcctttttactggrctgtgtcacgcggcatgaaattacacagctcaggcctgtaatcccagcactttagggggccgaggtgggcagatcacttgagtccaggagttgaagactagccagggcatcatggcgaaaccccatctctacaaaaaattccaaaaaagattagtcgggcctggtggtgcgtacctgttatcccagttactggagaggctgaggtgggaggatcgcttgggccgaggagctggacgttgcagtgagctgagatggccccgctgcactcttgtctctaacaaacaaaatggaccaaaacaaagtgaaatgtcatttgatttgtgtcatctggtttgatgacttttttttttttttttttagacagagtctcactctgtcgcccaggctggagtgcagtggcaagatctcggctcactgcaacctccgcttccggggttcaagcaattgtcctgcctcagcctcctgagtagctcagattacaacgcctggctaatttttgtatttttagcagagacggggtttcaccatgttcgccaggatagtctccatctcttgacctcgtgatccgcctgcctcggcctcccagtgccgggattacaggcgtgagccaccgcgcctggccaaaatatataaccttaagtgtaagtttactaactttggaaagtacttacaccagcataaaccgaccccctttcaagatctacattattttatttatttatttatttatttgagacagtttctcccttgttgcccaggctggagtgcaatggggcaatatcagctcaccgcaacctctgcttcccaggtttgagcgattctcctgcctcagcctcccgggtggctgggattacagacatgtgccaccactcccagctaattttgtatttttagtagagatagggtttctccatgttggtcaggctggttttgaactcccgacctcaggtgatccgcccgcctcggcctcccaaagtgttgggattacaggcgtgaaccaccgtgcccagccaagatctacactattatgtcaccccagaaagtgaactctcactcttcccagccagtctctttcttatcataggttagcttgcttattctggaatttcgcgtatacagatgcgtgccatgccataggtactcttttgtgtctgctttattctgctcaacaccatgtttctgaaatcattaccattgttgtatggttctctaactccatcatttccatttcagactcagcatatgctgagttcaacctgttgaagggctatctctgtttaattcaccatcttgaaagaaacatttaaaattgagatgttttcaagaatatatagttaaatcctgaggaatcgatgtagaaatgttatcacaagctgtctgaacttactcaggggaagtcttcgtcttcactcacataagagtctactggaattaatatcaacaatcttagagaaatcccacactattcatgccattttcatgatctccaccttggtaattttttttttttttgagacagagtctcgctctgtcacccaggctgaagtgcagtggtgcgatctcggctcactgcaacctctgcctcccgggttcaagtgattcttctgcctcagcctcccaagtagctggaactgtaggcacgtgccaccatgccctgctaattttttgtaattttagtagagatgggtttcaccgtgttagctaggatggtctcaatctcctgatctcgtggtccacccacctcggcttcccaaagtgctgagattgcaggcgtgagccaccacacccggcccaccttgttaatttttgagcactaaaatttgatacttatttgtgaatgaagtaatctcttcattgtattttttttttttacttatgctgagcttcaaatgacaaagattcatataatccaagagagaagtattatttagagggattcttttaccatgtgatatataataaatgcatccaatgttatacatcaatttaaaaaacaagtaaataactttaaagaaaagataactactggccaggtgcagtggctcacacctgtattcccagcactttgggaggccgaggcaggtggatcaagaggtcacgagttggagaccagcctggccaagatggtgaaaccctgtttctactcaaaatacaaaaattagccgagtgcggtggcaggcgcctgtaatcccagttactcagtagctgaggcaggagaatcgcttgaacccgggaggcggaggttgcagtgagctgagatcatgccactgcaatctagcctgggtgacagagcaagactttgtctccaaacaaaaagaaaagataattactttatacttagcttgtcttagccatgagtgacgggctgcatgtggcccaggacagttttgaatgcagttcaacacaaatttgtaaactttcttaaaacattaggagattttggccaggtacagtggctcatgcctgtaatcccagcactttgggaggctgaggcgggcagattacctgaggtcaggagttcgagaccaccctggccaacatggcaaaaccccatctccacaaaaaatacaaaaatttgctgagtgcattgtcaggcacctgtactcccagctactcaggaggctgaggcaggagaatcacttgaacctgagaggcagaggttgcagtgagccgagagcacgccactgcactccagcctgggtgacagagtgagaccccatctcaaaaacaaaacaccaaacaaaaacaaaaacaaaaaaaaatggctgggcacggtggctcacacctgtaatcccagcactttgggaggccgaggcaggcagatcgcctgccaggagttcaaggccagactggccaacatggtgaaacctcatctctactaaaaatacaaaaatgagtcgggcatggtggcagagacctgtaatctcagctactcgggaggctgagggaggagaatggcttgagcccaggagctggaggttgcagtgagccgagattgcaccactgcactccagcctgggcgactgagtggagcggaactctgtctccaaaaaaaaaaaaaaaaagagtttttttttagatcatcagctattgttagtgttagtgtatgttatgtgtggctcaagacaactttgtttcttttaatataggcagggaagtgaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcggtgtcattgaccttttcattatttcaactattattattccaggttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacattctcttctgcacaagttgcctttgtgtgagtatactaactttctgtagaggtatacttgtaatcacaaataagaataaattatataaaacaattcacgtttctggacttcattatgaatatgtggttttacccaaaaaatcagggaaatgatttattagcataagaattatgaaaatgtctgccatttacattatgaaaattaaataggtcggtgtttgtttaatagaatgtcaacagagcttttggtcaaaaataagtttttttagcctttgtgctatttatcacaaatggagtatgaggtttcgtcacttaaataggaaattctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggccggatggttgatgcttaaagagcaccctcttctgaggggagagggagatagatggagatgtaggccatttagaggggcagcaaatgatttttaggggaaatgaaagaggccaaggaacaaacaattggcctgagacaaagttcctctgaggtcatagggacgaggtgacaaactgccggaaggtgaagggcagaactgcactgcgtctcatgatgcagagaaagccccagagaatctcttagaactgccctccaagagaatcaatgaaaagtgtgtctgggcagggtaattttgaatgacatcattcaaagtgcatgttcccacttgcaactggagagagatcagtatgtcaaaagtctgtacttggtaagaatttggctgctaagttgtgccataatttgtcttttgagccttttttcctttgggtaagttgagctctacattttgtcttgccattcatgacagtaaaaatgtggttttctgggggctgaacctcctgaacaatgatccaagataaaagtactaataccacaatgcttttttatattcaagggaagaggaagtatgtttcagttttaccacctagataattacacgtcatttggcactgcctttcaagatatgtagaaaacagaaaatatatgagttatgaagatatctaggcacatttaacattctctatgccacttagtcctgaacagagaattttcggtataaattggaggaagcttttttttttttttttcttttctcacccccgagacgagtctccctctgttgcccaggctggagtataatggtgtgatctcggctcactgcaacctccacctcctggcttcaagtgattcccctgcctcagcctctcaagtagctgggattacaggtgcccaccaccatgcccagcaaatttttgtatttttagtagagtcggggttttaccatgttggccaggctagtctcaaaacccgacctcaaatgatccacccgcctcagcctcccaaagtgctgggattacaagcgtgagccaccacgtgagccaggggaagtttttaaatttaccactttttaacagttccatttaggaaagttcagttgagctgctggacttggacaacttcgcacctctcatctttgtccttgtcatctagtcatctataccattacctcctaagcagggacatcatgggtgccatgaagcattcatgcgtgatggcatttctttgcttgtcatttcttcatgtgtttgacatttctcctagctccaaactgggccagctacctttcctatgaaatctagtagtagctgtgggattgacgtggttgctcttttcatctttttagattacccattgcttctctcgaaatcctagtacatgattttttttttttatcctatgtgcagaaatcaggaaaaaacaaattctacaaagaatttgaaagatattatttcaggccaggtgtggtggctcatgcctgtaatcccagcactttgggaggctgaggcaggtggatgacttgaggtcaggagttcaagaccagatgggccaacatggtgaaaccccatctctactaaaaagacaaaaattagccaggcatggtagcaggcacctgtaatcccagctacttgggaggccgaggcacaagaatcgcttgaatctgggaggtggaggttgccgtgagccaaggtagtgccactgcacttcagcatggttgagagtgacactccatctcaagaaaaaagtcatttcaatgactacctcaggacattcataggtatctgacccacatctgagatgggatttgcattgcattttcgctatgatgagaacaaatatttaatatcttagaagattaaaagcatactgtgataatatggaaatcttggagggaattcagtcattagtgagaatgttttgcgttaagttcaaaccagcctcaatgaagctgatgtgagggaagggaaagtgaactctgagtagagcagggacaaaaggaagatgctccagtgcagatcaggaaggagcagggggtgaaatgttacaaattctagaactcagagarctgaaggtaattacttccttttcaacttgtgaaacatgttaacctgtggtaaaatacttataagatgataattaccatctaaccgtgttgaagtgtacagttcagttatgtgaagtatattcatgtcatttttttttttttttttgagacggagtctcactctgtcaccaggctggagtgcagtggtgggatcttggctcactgcaacctctgcctcctgggttcaagcagttctcctgcctcagcctcccgagtagctgggactacaggcgtgcatcaccatgctcagctaatttttgtatttttagtagagacggggtttcaccatgttgcccaggatggtctccatctcttgaccttgtgattcacccgcctcagcctcccaaagtgctgggattataggcgtgagctaccgcacctgggctattttttttttttttttttttttttgagacagagtttcaattttgttgcccaggtttggagtgcaatggcacaatctcagctcaccacaaccttttcctgctgggttcaagtgattctcctgcctcagcctcccgactagctgggactacaggcatgcaccaccatgcctggctaattttgtatttttagcagagacagcgtttctccatgttggtgaggctggtctcaaactcccgacctcaggtgatccgcctgcctcggcctcccaaagtgctgggattacaggagtgagccaccgtgccagcctcatgtcattcttgtgtgtgtgtgtgtgtgtgtgtgtgtgtgtgtgtgtgtgtgtgtgtgtgtgacagagtctcattctgtcgctcaggctggagtacagtggtgtgatctcggctcactgcaacctccgcctcccagcttcaaacggttctctgcctcagcctcccgagtagcttggattacaggcgcccgctgccatgcctggctaatttttgtatttttagtagagacagggtttcaccatcttggccaggctggtcttgaactcctgaccccgtgatccacctgcctccgcctcccaaagtactgggattatttatatgcatgagccaccgtgcccagccgtcattcttatattattatttcctaggtgtctttcctgaagactatcttctggtctcgaaatggacatgatggatccatggatgtacagcagagagcctggaggtccaaccrcagtagacagaaaggtatggctctgttggagtccccatagtgtggaaatgagtttgccctggaaagggaaagaacagcttcttgacctcaggtttctcaccttctcctctcctcactctcaccaagggctgaggtccatttgtatgcacacaaagaaaagagtttcttcctttcgaggaaataaaattggcctgaaagacgtcattactctacggaggcatgtggaaacaaaagttagarctaaaatccgtaagaggaaggtgacaacgaaaatcaaccgtcatgacaaaatcaatggaaagaggaagaccgccagaaaacagtaagatgtgccttgacacaaatactgttgtatgaaccatgtgccaatcaaagtagacaactgtaaagtccttgagaatattttctacaatatttgtggcaaattcagtgggctcaaaattgagtttgtcctttctgcttcattagtttaagctgtataattcctttcccttcctacattcttgtttgtaattttttcgggggaagaggagttgctagtactggcattggttttcctttctctctttttttttttttttcctgagatggagctttgctgttgttgcccaggctgtagtgcaatggcacaatctcagctcactgccttttggcttcaagcaattctcctgcctcagcctcccaagtagctgggattacaggtgcccaccaccacgcccagctaatttttgtatttttactagagatggggtttcaccatgttgtccaggctggtctcgaacttctgacctcaggtaatccacctgcctcagcctcccaaagtgctgggattagaggcgtgagccaccacatccagcctttttttttttttaaattttgagatagaatctcgctctgtcgcccaggctggagtgctatggtgcaatcttggctcactgcaacctctgcctcccagtttgaagcaattctgcctcagcttcctgagtagcttggattacaggtgtgtgccaccacattcggccaattttttttttttttttttttttgagacagagtctcactctgtcacccaggctagagtgcagtggcatgatcttggctcactgcaacctccgcctcccaggttcaagcgattcttatccctcagcctcttgagtagctgggactacaggcatatgccaccatgcccggataatttttgtattcttagtagaggcggggtttcaccatattggccaagctggtctagaactctggacatcatgatccacacacctcggcctcccaatgtgctgggattacaggcgtgagccaccgtgcctggcccaatttttgtatttttagtagagacaggggttcaccatgttggccaggctagtcttgaactcctgacctcaggtgatctgcctacctcagcctcccagtgtgagccaccgcacccagcctggattgttgaattcaatgcttgggtcacctccagattcattttcacagtctttcatgttttggtcatattacattgtattttgctgccatatgactgatctctttttgttaaatgtgagatacttgttaaaaaatatttagcaatgaattgaggcctagtggcatgttatcttgctgcagaagagatgggagtctacttctgggggatggtcacgggtcctccatacaggctgcaattgaggtcgtcggtgcaggctcagtccctacaaaggccagggtatttcctgtccacctctattctgatgcatgactcttctgggtctcaaccagagccagtggatttcagtacgggtcgctttcattggcagaccctcaatccacttgttttccatctaatcccacgcatgtgtgcaaaagctgctgtgcttctttgcatctcagtagttccttctgaaattcagcaatgaaactcagggaaatgggttccaaatgcgaggctgactttcgtcctgggtttccttcttctccatcttcacctcatgtctgtttactgccatgttagcaatttgatgtattcaatcatgggttttatattctgtttggtgtcccccattgttctcatcagagatcagaagcttcagatgcacttatgtcaactcaagagtagaatgcttccttagcttccctccagagtcaggttttgtgtttctagttcccaagtggacagcaggagtagtgatgtcctcactggcttctcatttgcattaagctgtgagcttctttaccgtggggacaggaccctgctcccattgcattctcagcaccacaccacacactccttgttggaggccactccagacagcatgtgctgaaggatgccctgtggtcagaaacaagttcattaactttctctttgaagtgttttcgcccctgtttcctagcgttctgggaattttacacatccttcctataaaaccaagtatcaggtgagatccttaggatcaggaccatgaatcaagtggtgtgagggcaacacagcaaacttaccctttttaggccatttcctttttctgccctcaatgtctgtgaagtgaaccttgttaaagtcagtcaacaccagggtggatggtttgccgttgtcacctattttcaggacataacaccctgacttaggagccattccgatcatttctaattcaatagatgcgcccagcattcagattgccttttctctcaaccaggatctttaaagtcgatgacaagagttccagtcctgaatcatggcaaagtgcagtagtgaactgaggggttaatgacaccatattctggaaggatctctctatggctgatggtctcagttccggcatcagcctctgactgagaagcaggtctcacacaggaagagtcagatgaggagcaatcctctgcttccgatggagttagttgtgatgagttggtgaggtctggtttttcacactgaactaaaatgatctttcgctgtgtcaagcacaagactgaccccagagacacacatagtgcacctcatagaagcttttaatagtctttatatttactaaagaataggactaactatggaactatgaagatgagctggaaatgacaggtgacttgccagcaggccagagtgtgattttttttggtccctcaatgggaggtgtccattctcccttcggttgtgagaatcagttggttcatttgtgggaaggttgcaggggggatctttgaatcacagccttcagatgccagaagggcagagggaatcccacatggactggtggatcatgtgtgtgcatttctctcccttctaacctgaggaaactaagcatgaaagaatgtgagcacgcagaaaaggagaggcaggtatcagaggcagaggaaaatgggaaattggatatgaaagaaatacacacctacaagtgagttcagaaactgaaccccaccctcctgggaaacgcccattggagtgttgtttttaacctctgtacaatgtttagacccagtaaatgcagaaatagaaacaaacggtcagaagacatatcgtgagagagagagagagagttcacaaaacagaaaacaaagtaccttaatatttaccagtgaccaaaagatgtgaagtaacaaaacggctcctgaccccattaccagctagactgtgtggaaactcggttcataccagccattctaggggtggggtgagttgttgtcatccttaggaaagtgtgttgttgtaggatcaaccacatccttcaaaaggactatgcctgtttataagcccagctgtttctgccctgtgaaacacggtaaggatattaatacaaagagaatacagctttatgataaaagatgctcaatgaaggatgaattagggatatactgagaatggggaaggaaactatcatctcagaagtcaacaggcagtaagcaagaggaggaatcaatacagcaacagtttggatcagaccgtacagtttttttgtttttgtttttgtttttgtttttctgagatggagtctcgctgtgtcacccaggctggagtgcaatgacgtgatcttggctcactgcaacctccgcctcccaggttcaagtgattcccctgcctcagcctcccgagtagctgggattacaggtgcctgccaccacgcccggctaatcttttgtatttttagtagagacggggtttcaccgtattagccaggatggtctcaatctcctgacctcgtgatccatccgcctcgccctcccagagtgctgggactacaggcatcagccaccgtgaccggctcagactgtactcttatagccatctgaaatacgttttctaggtagagatagattgtgtaagggtacagttgtgaggataacagaaacatggcagattatttaaaatcatcctgaacgtggtgctttatctgatgaaagtgattgtaatccataggaaaatgtttcaacgtgcgcaagagttgcggcggcgggcagaggactaccacaaatgcaaagtaaggagcttcctccccgcagttgcaggatagttcagtgctgatgcagatgatgccacggctcttagactctctcaacattcaatttctcatgtgttggctttttcagatccccccttctgcaagaaagcctctttgcaactgggtaagtttgtttgttttccttgcttttgaacatagtctgccaggtcaggacatggatacatttttctccctacagctctgtgctcaagccctgcagagggagatggcagagaggaaggctgcctacaggcatcacagtcccatccctgttggtaaccgtgttgtgcaaaaacaccttcatccccacccagtggggcccctgatctaaattcaaagtgtcagaggttccatatttgtaatagcaaatgggccctgactgtaaattagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaagtgacttcttgaggtgagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagagtcagagacagaacatgaaaggcctggaaaacattctccaaaaagaagctgcaacatgtgtggacaatgggcttttcatgcctctcttactgtctcttactgtctgttgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccccagctgtcggcagtactcagtggaagggtgatattatgacactgatactgctattttgaaacctggaggatggaaaggtgcaaaaatctatcaccagcaacagaaggtgcagactgtgttggtggtggtaattttgtccatcaaatgaatatgtgtgaaaacattccctcctttggccctacaggtcagaatggcggcagcggagcatcgtcattcttcaggattgccctactggctctacctcacagctgaaactttaaaaaacaggatgggccgccagccacctcctccaactcaacaacattctataactgataactccctgagcctcaagacacctcctgagtgtctgctcactccccttccaccctcagtggatgataatatcaaggagtgtcctcttgctcctcttccaccctctcctcttccaccctcagtggatgataatctgaaggaatgtctctttgtcccgcttccaccctctcctcttccaccctcagtggatgataatctgaaggaatgtctctttgtcccgcttccaccctctcctcttccaccctcagtggatgataatctcaagactcctcccttagctactcaggaggccgaggtggaaaaaccacccaaacccaagaggtggagggtggatgaggtggaacaatcaccgaaacccaagaggcggagggtggatgaggtggaacaatcgcccaagcccaagaggcagagggaggccgaggcacaacaattacccaaacccaagaggcggaggttgagtaagctgagaacacgccattgcactcaagcctgggcaataagaataaatccgtaggtcgaaaaaaagaaaaaaatcaaaaaacaaaacaaaacccacgctccaaaaacaaactaacgaagaataaataaataatataaaaataaaataaatactgcagtcctta

SEQ ID NO: 13278 - DNA, 9712 bp, Homo sapiens
cacagattccttggacatccctgagaggtcaatcatgaaggtcaacttggttttctccccctcatttgggttcagaatttaaagtccacacacacaggcagtaagatgattatagataaggacatcatcactcggtttcggatgttaaattgtctaggtgggttaggggtgatttgagatcacacaaccttgtgccacaaagaggaattcccaggccagagggagacattttattgccatgttatgatcttatcattgagttgaaaggcaatcttgtttcattttggattctttcttatgtttatgtcttataagggcactttgaatttccaagcaaataataattttgaattagcttttaatcattgacttctagcacagttatatgatcagaaacgtgctgtgtgatttgattgctctcaaatatattgagatttgctggaacaaaataagtcaggttaatttttgtaaatgtaccatgcttgcttaaaatgaatgtatctacatttgttcctgagatacgggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcgcccagaagcagggacagggagctggttggggaggaccagaaatcaggtttgtgaaggttccagagaggacctgtccttgcgaggagtgtgggagactgagatgggggaggggtcattggaatgatgcgggcgctacttggcattgtccattgtgaggcaccaccggggtcatcagggattggtggagagggagtataaagccccaggtttgctaagggagggcccagaccgaagaaggtttggcggatagcagaacctttttgtctccctctaattgctcctaagcctcacgctcccttgccccgcgtgtcctgttgcttccctgatcttctccgtgacctgtagctaaaccttccaccagcgcttgagaacttaatttgaaccggatcctttcccagacccctttcttcttctcctcctccacctcctccaggtgcccaacagcccccttctcctcctttcccttcccttacttccccccttcccctccccttcccctccccctcccctccccttcccctccccttccccttcccctccccctccccttcccctccccctccccttcccctccccctcccctcccccgccccaactcagatccggccccggtccccgtccccttccctcccccctgccctaagccacctccacctctgtcctggccgcctcagggcaccctgaaaggatcaggacatgcggctgcgcttttggctcctcatttggctcctgctgggatttatcagccatcagcccacccctgtgagtagacgctggacccgcggggtttcttcctttttactgggctgtgtcacgcggcatgaaattacacagctcaggcctgtaatcccagcactttagggggccgaggtgggcagatcacttgagtccaggagttgaagactagccagggcatcatggcgaaaccccatctctacaaaaaattccaaaaaagattagtcgggcctggtggtgcgtacctgttatcccagttactggagaggctgaggtgggaggatcgcttgggccgaggagctggacgttgcagtgagctgagatggccccgctgcactcttgtctctaacaaacaaaatggaccaaaacaaagtgaaatgtcatttgatttgtgtcatctggtttgatgacttttttttttttttttttagacagagtctcactctgtcgcccaggctggagtgcagtggcaagatctcggctcactgcaacctccgcttccggggttcaagcaattgtcctgcctcagcctcctgagtagctcagattacaacgcctggctaatttttgtatttttagtagagacggggtttcaccatgttcgccaggatagtctccatctcttgacctcgtgatccgcctgcctcggcctcccagtgccgggattacaggcgtgagccaccgcgcctggccaaaatatataaccttaagtgtaagtttactaactttggaaagtacatacaccagcataaaccgaccccctttcaagatctacattattttatttatttatttatttttttgagacagtttctcccttgttgcccaggctggagtgcaatggggcaatatcagctcaccgcaacctctgcttcccaggtttgagcgattctcctgcctcagcctcccgggtggctgggattacagacatgtggcaccactcccagctaattttgtatttttagtagagatagggtttctccatgttggtcaggctggttttgaactcctgacctcaggtgatccgcccgcctcggcctcccaaagcgttgggattacaggcgtgaaccaccgtgcccagccaagatctacactattatgtcaccccagaaagtgaactctcagtcttcccagccagtctctttcttatcataggttagcttgcttattctggaatttcgcgtatacagatgcgtgccatgccataggtactcttttgtgtctgctttgttctgctcaacaccatgtttctgaaatcattaccattgttgtatggttctctaactccatcatttccatttcagactcagcatatgctgagttcaacctgttgaagggctatctctgtttaattcaccatcttgaaagaaacatttaaaattgagatgttttcaagaatatatagttaaatcttgaggaatcgatgtagaaatgttatcacaagctgtctgaacttactcaggggaagtcttcgtcttcactcacataagagtctactggaattaatatcaacaatcttagagaaatcccacactattcatgccattttcatgatctccaccttggtaattttttttttttttttttttttttgagacagagtctcactctgtcacccaggctgaagtgcagtggtgcgatctcggctcactgcaacctctgcctcctgggttcaagtgattcttctgcctcagcctcccaagtagctggaactgtaggcacgtgccaccatgccctgctaattttttgtaattttagtagagatgggtttcaccgtgttagctaggatggtctcaatctcctgatctcgtggtccacccacctcggcttcccaaagtgctgagattgcaggcgtgagccaccacacccggcccaccttgttaatttttaagcactaaaatttgatacttatttgtgaatgaagtaatctcttcattgtattttttttttttacttatgctgagcttcaaatgacaaagattcatataatccaagagagaagtattatttagagggattcttttaccatgtgatatataataaatgcatccaatgttatacatcaatttaaaaaacaagtaaataactttaaagaaaagataactactggccaggtgcagtggctcacacctgtattcccagcactttgggaggccgaggcaggtggatcaagaggtcacgagttggagaccagcctggccaagatggtgaaaccctgtttctactcaaaatacaaaaattagccgagtgcggtggcaggcgcctgtaatcccagttactcagtagctgaggcaggagaatcgcttgaacccgggaggcggaggttgcagtgagctgagatcatgccactgcaatctagcctgggtgacagagcaagactttgtctccaaacaaaaagaaaagataattactttatacttagcttgtcttagccatgagtgacgggctgcatgtggcccaggacagttttgaatgcagttcaacacaaatttgtaaactttcttaaaacattaggagattttggccaggtacagtggctcatgcctgtaatcccagcactttgggaggctgaggcgggcagattacctgaggtcaggagttcgagaccaccctggccaacatggcaaaatcccatctccacaaaaaatacaaaaatttgctgagtgcattgtcaggcacctgtactcccagctactcaggaggctgaggcaggagaatcacttgaacctgagaggcagaggttgcagtgagccgagagcacgccactgcactccagcctgggtgacagagtgagaccccatctcaaaaacaaaacaccaaacaaaaacaaaaacaaaaaaaaatggctgggcacggtggctcacacctgtaatcccagcactttgggaggccgaggcaggcagatcgcctgccaggagttcaaggccagactggccaacatggtgaaacctcatctctactaaaaatacaaaaatgagtcgggcatcgtggcagagacctgtaatctcagctactcgggaggctgagggaggagaatggcttgagcccaggagctggaggttgcagtgagccgagattgcaccactgcactccagcctgggcgactgagtggagcggaactctgtctccaaaaaaaaaaaaaaaagagtttttttttagatcatcagctattgttagtgttagtgtatgttatgtgtggctcaagacaactttgtttcttttaatataggcagggaagtgaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcggtgtcattgaccttttcattatttcaactattattattccaggttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacgttctcttctgcacaagttgcctttgtgtgagtatactaactttctgtagaggtatacttgtaatcacaaataagaataaattatataaaacaattcacgtttctggacttcattatgaatatgtggttttacccaaaaaatcagggaaatgatttattagcataagaattatgaaaatgtctgccatttacattatgaaaattaaataggtcggtgtttgtttaatagaatgtcaacagagcttttggtcaaaaataagtttttttagcctttgtgctatttatcacaaatggagtatgaggtttcgtcacttaaataggaaattctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggccggatggttgatgcttaaagagcaccctcttctgaggggagagggagatagatggagatgtaggccatttagaggggcagcaaatgatttttaggggaaatgaaagaggccaaggaacaaacaattggcctgagacaaagttcctctgaggtcatagggacgaggtgacaaactgccggaaggtgaagggcagaactgcactgcgtctcatgatgcagagaaagccccagagaatctcttagaactgccctccaagagaatcaatgaaaagtgtgtctgggcagggtaattttgaatgacatcattcaaagtgcatgttcccacttgcaactggagagagatcagtatgtcaaaagtctgtacttggtaagaatttggctgctaagttgtgccataatttgtcttttgagccttttttcctttgggtaagttgagctctacattttgtcttgccattcatgacagtaaaaatgtggttttctgggggctgaacctcctgaacaatgatccaagataaaagtactaataccacaatgcttttttatattcaagggaagaggaagtatgtttcagttttaccacctagataattacacgtcatttggcactgcctttcaagatatgtagaaaacagaaaatatatgagttatgaagatatctaggcacatttaacattctctatgccacttagtcctgaacagagaattttcggtataaattggaggaagctttttttttttttttttcttttctcacccccgagacgagtctccctctgttgcccaggctggagtataatggtgtgatctcggctcactgcaacctccacctcctggcttcaagcgattcccctgcctcagcctctcaagtagctgggattacaggtgcccaccaccatgcccagcaaatttttgtatttttagtagagtcggggttttaccatgttggccaggctagtctcaaaacccgacctcaaatgatccacccgcctcagcctcccaaagtgctgggattacaagcgtgagccaccacgtgagccaggggaagtttttaaatttaccactttttaacagttccatttaggaaagttcagttgagctgctggacttggacaacttcgcacctctcatctttgtccttgtcatctagtcatctataccattacctcctaagcagggacatcatgggtgccatgaagcattcatgcgtgatggcatttctttgcttgtcatttcttcatgtgtttgacatttctcctagctccaaactgggccagctacctttcctatgaaatctagtagtagctgtgggattgacgtggttgctcttttcatctttttagattacccattgcttctctcgaaatcctagtacatgattttttttttttatcctatgtgcagaaatcaggaaaaaacaaattctacaaagaatttgaaagatattatttcaggccaggtgtggtggctcatgcctgtaatcccagcactttgggaggctgaggcaggtggatgacttgaggtcaggagttcaagaccagatgggccaacatggtgaaaccccatctctactaaaaagacaaaaattagccaggcatggtagcaggcacctgtaatcccagctacttgggaggccgaggcacaagaatcgcttgaatctgggaggtggaggttgccgtgagccaaggtagtgccactgcacttcagcatggttgagagtgacactccatctcaagaaaaaagtcatttcaatgactacctcaggacattcataggtatctgacccacatctgagatgggatttgcattgcattttcgctatgatgagaacaaatatttaatatcttagaagattaaaagcatactgtgataatatggaaatcttggagggaattcagtcattagtgagaatgttttgcgttaagttcaaaccagcctcaatgaagctgatgtgagggaagggaaagtgaactctgagtagagcagggacagaaggaagatgctccagtgcagatcaggaaggagcagggggtgaaatgttacaaattctagaactcagagagctgaaggtaattacttccttttcaagttgtgaaacatgttaacctgtggtaaaatacttataagatgataattaccatctaaccgtgttgaagtgtacagttcagttgtgtgaagtatattcatgtcattttttttttttttttttttgagacggagtctcactctgtcaccaggctggagtgcagtggtgggatcttggctcactgcaacctctgcctcctgggttcaagcagttctcctgcctcagcctcccgagtagctgggactacaggcgtgcatcaccatgctcagctaatttttgtatttttagtagagacggggtttcaccatgttgcccaggatggtctccatctcttgaccttgtgattcacccgcctcagcctcccaaagtgctgggattacaggcgtgagctaccgcacctgggctattttttttttttttttttttttttttgagacagagtttcaattttgttgcccaggtttggagtgcaatggcacaatctcagctcaccacaaccttttcttgctgggttcaagtgattctcctgcctcagcctcccgactagctgggactacaggcatgcaccaccatgcctggctaattttgtatttttagcagagacagcgtttctccatgttggtgaggctggtctcaaactcccgacctcaggtgatccgcctgcctcggcctcccaaagtgctgggattacaggagtgagccaccgtgccagcctcatgtcattcttgtgtgtgtgtgtgtgtgtgtgtgtgtgtgtgtgtgtgtgtgtgtgagacagagtctcattctgtcgctcaggctggagtacagtggtgtgatctcggctcactgcaacctccgcctcccagcttcaaacggttctctgcctcagcctcccgagtagcttggattacaggcgcccgctgccatgcctggctaatttttgtatttttagtagagacagggtttcaccatcttggccaggctggtcttgaactcctgaccccgtgatccacctgcctcggcctcccaaagtactgggattatttatacgcatgagccaccgtgcccagccgtcattcttatattattatttcctaggtgtctttcctgaagactatcttctggtctcgaaatggacatgatggatccatggatgtacagcagagagcctggaggtccaaccgcagtagacagaaaggtatggctctgttggagtccccatagtgtggaaatgagtttgccctggaaagggaaagaacagcttcttgacctcaggtttctcaccttctcctctcctcactctcaccaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagtaagatgtgccttgacacaaatactgttgtatgaaccatgtgccaatcaaagtagacaactgtaaagtccttgagaatattttctacaatatttgtggcaaattcagtgggctcaaaattgagtttgtcctttctgcttcattagtttaagctgtataattcctttcccttcctacattcttgtttgtaattttttcgggggaagaggagttgctagtactggcattggttttcctttctctctttttttttttttttcctgagatggagctttgctgttgttgcccaggctgtagtgcaatggcacaatctcagctcactgtcttttgacttcaagcaattctcctgcctcagcctcccaagtagctgggattacaggtgcccaccaccacgcccagctaatttttgtatttttactagagatggggtttcaccatgttgtccaggctggtctcgaacttctgacctcaggtaatccacctgcctcagcct

SEQ ID NO: 13279 - DNA, 14260 bp, Homo sapiens
caacttagatccggccccggtccccgtccccttccctcccccctgccctaagccacctccacctctgtcctggccgcctcagggcgccctgaaaggaccaggacatgcggctgcgcttttggctcctcatttggctcctgctgggatttatcagccatcagcccacccctgtgagtagacgctggacccgccgggtttcttcctttttactgggctgtgtcacgcggcatgaaattacacagctcaggcctgtaatcccagcactttagggggccgaggtgggcagatcacttgagtccaggagttgaagactagccagggcatcatggcgaaaccccatctctacaaaaaattccaaaaaagattagtcgggcctggtggtgcgtacctgttatcacagttactggagaggctgaggtgggaggatcgcttgggcccaggagctggacgttgcagtgagctgagatggccccgctgcactcttgtctctaacaaacaaaatggaccaaaacaaagtgaaatgtcatttgatttgtgtcacctggtttgatgcctttttttttttttttttttttttgacagagtctcactctgtcgcccaggctggagtgcagtggcaagatctcggctcactgcaacctccgcttccggggttcaagcaattgtcctgcctcagcctcctgagtagctcagattacaacgcctggctaatttttgtatttttagtagagacggggttttaccatgttcgccaggatagtctccatctcttgacctcgtgatccgcctgcctcggcctcccagtgctgggattacaggcgtgaaccaccgcgcctggccaaaatatataaccttaagtgtaagtttactaactttggaaagtacatacaccagcataaaccgaccccctttcaagatctacattattttatttatttatttatttatttgagacagtttctcccttgttgtccaggctggagtgcaatggggcaatatcagctcaccgcaaccgctgcttcccaggttcgagcgattctcctgcctcagcctcccgagtggctgggattacagacatgtgccaccactcccagctaattttgtatttttagtagagatagggtttctccatgttggtcaggctggttttgaactcccgacctcaggtgatccgcccgccttggcctcccaaagtgttgggattacaggcgtgaaccaccgtgcccagccaagatctacactattatgtcaccccagaaagtgaactcccactcttcccagccagtctctttcttatcataggttagcttgcttattctggaatttcgcgtatacagatgcatgccatgccataggtactcttttgtgtctgctttattctgctcaacaccatgtttctgaaatcattaccgttgttgtatggttctctaactccatcatttccatttcagactcagcatatgctgagttccacctgttgaagggctatctctgtttaattcaccatcttgaaagaaacatttaaaattgagatgttttcaagaatatatagttaaatcctgaggaatcgatgtagaaatgttatcacaagctgtctgaacttactcaggggaagtcttcgtcttcactcacataagagtctaatggaattaatatcaacaatcttagagaaatcccacactattcatgccattttcatgatctccaccttggtaattttttttttttttttttttttgagacagagtctcgctctgtcacccaggctgaagtgcagtggtgcgatctcggctcactgcaacctctgcctcctgggttcaagtgattcttctgcctcagcctcccaagtagctggaactataggcacgtgccaccatgccctgctaattttttgtaattttagtagagatgggtttcaccgtgttagctaggatggtctcaatctcctgatctcgtggtccacccacctcggcttcccaaagtgctgggattgcaggcgtgagccaccacacccggcccaccttgttaatttttaagcactaaaatttgatacttatttgtgaatgaagtaatctcttcattgtatttttttttttttttttacttatgctgagctttaaatgacaaagattcatataatccaagagagaagtattatttagagggattcttttaccatgtgatatataataaatgcatccaatgttatacatcaatttaaaaaacaagtaaataactttaaagaaaagataactactggccaggtgcagtggctcacacctgtattcccagcactttgggaggccgaggcaggtggatcaagaggtcacgagttggagaccagcctggccaagatggtgaaaccctgtttctactaaaaatacaaaaattagccgagtgcggtggcaggcgcctgtaatcccagttactcagtagctgaggcaggagaatcgcttgaacccgggaggcggaggttgcagtgagctgagatcatgccactgcaatctagcctgggtgacagagcaagactttgtctccaaacaaaaagaaaagataattactttatacttagcttgtcttagccatgagtgacgggctgcatgtggcccaggacagttttgaatgcagttcaacacaaatttgtaaactttcttaaaacattaggagattttggccaggtacagtggctcatgcctgtaatcccagcactttgggaggttgaggcgggcagattacctgaggtcaggagttcgagaccaccctggccaacatggcaaaaccccatctccacaaaaaatacaaaaatttgctgagtgcattgtcaggcacctgtactcccagctactcaggaggctgaggcaggagaatcacttgaacctgagaggcagaggttgcagtgagccgagagcacgccactgcactccagcctgggtgacagagtgagaccccatctcaaaaacaaaacaccaaacaaaaacaaaaacaaaaaaaaatggctgggcacggtggctcacacctgtaatcccagtactttcagaggccgaggcaggcagatcgcctgccaggagttcaaggccagactggccaacatggtgaaacctcatctctactaaaaatacaaaaatgagtcgggcatggtggcagagacctgtaatctcagctactcgggaggctgagggaggagaatggcttgagcccaggagctggaggttgcagtgagccgagattgcaccactgcactccagcctgggcgactgagtggagcggaactctgtctccaaaaaaaaaaaaaaagagtttttttttagatcatcagctattgttagtgttagtgtatgttatgtgtggctcaagacaactttgcttcttttaatataggcagggaagtgaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcggtgtcattgaccttttcattctttcaactattattattccaggtcatcaatagtctggctgtctatcgtcatcgtgagactgactttggtgtaggagttcgagaccaccctggccaacatggcaaaaccccatctccacaaaaattggataatttgataattatcattattgggtttctgagacgtgacacatttaccattctcttctgcacaagttacctttgtgtgagtatactaactttctgtagaggtatacttgtaatcacaaataagaataaattatataaaacaattcacgtttctggacttcattatgaatatgtggttttacccaaaaaatcagggaaatgatttattagcataagaattatgaaaatgtctgccatttacattatgaaaattaaataggtcggtgtttgtttaatagaatgtcaacagagcttttggtcaaaaataagtttttttagcctttgtgctatttatcacaaatggagtatgaggtttcgtcacttaaataggaaattctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggccggatggttgatgcttaaagagcaccctcttctgaggggagagggagatagatggagatgtaggccatttagaggggcagcaaatgatttttaggggaaatgaaagaggccaaggaacaaacaattggcctgagacaaagttcctctgaggtcatagggacgaggtgacaaactgccggaaggtgaagggcagaactgcactgcgtctcatgatgcagagaaagccccagagaatctcttagaactgccctccaagagaatcaatgaaaagtgtgtctgggcagggtaattttgaatgacatcattcaaagtgcatgttcccacttgcaactggaaagagatcagtatgtcaaaagtctgtacttggtaagaatttggctgctaagttgtgccataatttgtcttttgagccttttttcctttgggtaagttgagctctacattttgtcttaccattcatgacagtaaaaatgtggttttctgggggctgaacctccttctgaacaatgatccaagataaaagtactaataccacaatgcttttttatattcaagggaagaggaagtatgtttcagttttaccacctagataattacaagtcatttggcactgcctttcaagatatgtagaaaacagaaaatatatgagttatgaagatatctaggcacatttaacattctctatgccacttagtcctgaacagagaatttttggtataaattggaggaagctttttttttttttttttttttcttttctcacccccgaaacgagtctccctctgttgcccaggctggagtataatggtgtgatctcggctcactgcaacctccacctcctggcttcaagcgattcccctgcctcagcctctcaagtagctgggattacaggtgcccaccaccatgcccagcaaatttttgtatttttagtagagtcggggttttaccatgttggccaggctagtctcaaaacccgacctcaaatgatccacccgcctcagcctcccaaagtgctgggattacaagcgtgagccaccacgtgagccaggggaagtttttaaatttaccactttttaacagttccatttaggaaagttcagttgagctgctggacttggacaacttcgcacctctcatctttgtccttgtcatctagtcatctataccattacctcctaagcagggacatcatgggtgccatgaagcattcatgcgtgatggcatttctttgcttctcatttcttcatgtgtttgacatttctcctagctccaaactgggccagctacctttcctatgaaatctagtagtagctgtgggattgacgtggttgctcttttcatctttttagattacccattgcttctctcgaaatcctagtatatgattttttttttttatcctatgtgcagaaatcaggaaaaaacaaattctacaaagaatttgaaagatattatttcaggccaggtgtggtggctcatgcctgtaatcccagcactttgggaggctgaggcaggtggatgacttgaggtcaggagttcaagaccagatgggccaacatggtgaaaccccatctctactaaaaagacaaaaattagccaggcatggtagcaggcacctataatcccagctacttgggaggccgaggcacaagaatcgcttgaatctgggaggtggaggttgccgtgagccaaggtagcgccactgcacttcagcatggttgagagtgacactccatctcaagaaaaaagtcatttcaatgactacctcaggagattcataggtatctgacccacatctgagatgggatttgcattgcattttcgctatgatgagaacaaatatttaatatcttagaagattaaaagcatactgtgataatatggaaatcttggtgggaattcagtcattagtgagaatgttttgcgttaagttcaaaccagcctcaatgaagctgatgtgagggaagggaaagtgaactctgagtagagcagggacagaaggaagatgctccagtgcagatcaggaaggagcagggggtgaaatgttacaaattctagaactcagagagctgaaggtaattacttccttttcaagttgtgaaacatgttaacctgtggtaaaatacttataagatgataattaccatctaaccgtgttgaagtgtacagttcagttgtgtgaagtatattcatgtcattttttttttttttttgagacggagtctcactctgtcaccaggctggagtgcagtggtgggatcttggctcactgcaacctctgcctcctgggttcaagcagttctcctgcctcagcctcccgagtagctgggactacaggcgtgcatcaccatgctcagctaatttttgtatttttagtagagacggggtttcaccatgttgcccaggatggtctccatctcttgaccttgtgattcacccgcctcagcctcccaaagtgctgggattacaggcgtgagctaccgcacctggcctatttttttttttttttttttttttttttttgagacagagtttcaattttgttgcccaggtttggagtgcaatggcacaatctcagctcaccacaaccttttcctgctgggttcaagtgattctcctgcctcagcctcccgactagctgggattacaggcatgcaccaccatgcctggctaattttgtatttttagcagagacagcatttctccatgttggtgaggctggtctcaaactcccgacctcaggtgatccacctgcctcggcctcccaaagtgctgggattacaggagtgagtcaccgtgccagcctcatgtcattcttgtgtgtgtgtgtgtgtgtgtgtgtgtgtgtgtgtgtgtgtgtgacagagtctcattctgtcgctcaggctggagtacagtggtgtgatctcggctcactgcaacctccgcctcccagcttcaaacggttctctgcctcagcctcccgagtagcttggattacaggcgcccgctgccatgcctggctaatttttgtatttttagtagagacagggtttcaccatcttggccaggctggtcttgaactcctgaccccgtgatccacctgcctcggcctcccaaagtactgggattatttatacgcatgagccaccgtgcccagccgtcattcttatattattatttcctaggtgtctttcctgaagactatcttctggtctcgaaatggacatgatggatccacggatgtacagcagagagcctggaggtccaaccgcagtagacagaaaggtatggctctgttggagtccccatagtgtggaaatgagtttgccctggaaagggaaagaacagcttcttgacctcaggtttctcaccttctcctctcctcactctcaccaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagtaagatgtgccttgacacaaatactgttgtatgaaccatgtgccaatcaaagtagacaactgtaaagtccttgagaatattttctacaatatttgtggcaaattcagtgggctcaaaattgagtttgtcctttctgcttcattagtttaagctgtataattcctttcccttcctacattcttgtttgtaattttttcgggggaagaggagttgctagtactggcattggttttcctttctctcttttttttttttttcctgagatggagctttgctgttgttgcccaggctgtagtgcaatggcacaatctcagctcactgccttttggcttcaagcaattctcctgcctcagcctcccaagtagctgggattacaggtgcccaccaccacgcccagctaatttttgtatttttactagagatggggtttcaccatgttgtccaggctggtctcgaacttctgacctcaggtaatccacctgcctcagcctcccaaagtgctgggattagaggtgtgagccaccacacccagccttttttttttttttttttttaaattttgagatagaatctcgctctgtcgcccaggctggagtgctatggtgcaatcttggctcactgcaacctctgcctcccagtttgaagcaattctgcctcagcttcctgagtagcttggattacaggtgtgtgccaccacattcggccaatttttttttttttttttttgagacagagtctcactctgtcacccaggctagagtgcagtggcatgatcttggctcactgcaacctccgcctcccaggttcaagcgattcttatccctcagcctcttgagtagctgggactacaggcatatgccaccatgcccggataatttttgtattcttagtagaggcggggtttcaccatattggccaagctggtctagaactctggacatcatgatccacatacctcggcctcccaatgtgctgggattacaggcgtgagccaccgtgcccggcccaatttttgtatttttagtagagacaggggttcaccatgttggccaggctagtcttgaactcctgacctcaggtgatctgcctacctcagcctcccagtgtgagccaccgcacccagcctggattgttgaattcaatgcttgggtcacctccagattcattttcacagtctttcatgttttggtcatattacattgtattttgctgccatatgactgatctctttttgttaaatgtgagatacttgttaaaaaatatttagcaatgaattgaggcctagtggcatgttatcttgctgcagaagagatgggagtctacttctgggggatggtcacgggtcctccatacaggctgcaattgaggtcgtcggtgcaggctcagtccctagaaaggccagggtatttcctgtccacctctattctgatgcatgactcttctgggtctcaaccagagccagtggacttcagtacgggtcgctttcattggcagaccctcaatccacttgttttccatctaatcccacgcatgtgtgcaaaagctgctgtgcttctttgcatctcagtagttccttctggaattcagcaatgaaactcagggaaatggattccaaatgcgaggctgactttcgtcctgggtttccttcttctccatcttcacctcatgtctgtttactgccatgttagctatttgatgtattcaatcatgggttttatattctgtttggtgtcccccattgttctcatcggagatcagaagcttcagatgcacttatgtcaactcaagagtagaatgcttccttagcttccctccagagtcaggttttgtgtttctagttcccaagtgcacagcaggagtagtgatgtcctcactggcttctcatttgcattaaactgtgagcttctttagcgtggggacaggaccctgctcccattgcattctcagcaccacaccacacactccttgttggaggccactccagacagcatgtgctgaaggatgccctgtggtcagaaacaagttcattaactttccctttgaagtgttttcgcccctgtttcctagcgttctgggaattttacacatccttcctataaaaccaagtatcaggtgagatccttaggatcaggaccatgaatcaagtggtgtgagggcaacacagcaaacttaccctttttaggccatttcctttttctgccctcaaactctgtgaactgaaccttgttaaagtcagtcaacaccagggtggatggtttgccgttgtcacctattttcaggacataacaccctgacttaggagccattccgatcatttctaattcaatagatgcacccagcattcagattgccttttctctcaaccaggatctttaaagtcgatgacaagagttccagtcctgaatcatggcaaagtgcagtagtgaactgcggggttaatgacaccatattctggaaggatctctctatggctgatggtctcagttctggcatcagcctctgactgagaagcaggtctcacacaggaagagtcagatgaggagcaatcctctgcttccgatggagttagttgtgatgagttggtgaggtctggtttttcacactgaactaaaatgatctttcgctgtgtcaaacacaagactgaccccagacacacacatagtgcacctcatagaagcttttaatagtctttatatttactaaagaataggactaactatggaactatgaagatgagctggaaatgacaggtgacttgccagcaggccagagtgtgattttttttggtccctcaatgggaggtgtccattctcccttcggttgtgagaatcagttggttcatttgtgggaaggttgcaggggggatctttgaatcacagccttcagatgccagaagggcagagggaatcccacatggactggtggatcatgtgtgtgcatttctctcccttctaacctgaggaaactaagcatgaaagaatgtgagcacacagaaaaggagaggcaggtatcagaggcagaggaaaatgggaaattggatatgaaagaaatacacacctacaagtgagttcagaaactgaaccccaccctcctgggaaacgcccattggagtgttgtttataacctctgtacaatgtttagacccagtaaatgcagaaatagaaacaaatggtcagaagacctatcgtgagagagagagagagttcacaaaacagaaaacaaagtacctgaatatttaccagtgaccaaaagatgtgaagtagcaaaacgtctcctgaccccattgccagctagactgtgtggaaactcggttcataccagccattctaggggtggggtgagttgttgtcatccttaggaaagtgtgttgttgtaggatcaaccacatccttcaaaaggactatgcctgtttataagcccagctctttctgccctgtgaaacacggtaaggatattaatacaaagagaatacagctttatgataaaagatgctcaatgaaggatgaattagggatatactgagaatggggaaggaaactatcatctcagaagtcagcaggcagtaagcaagaggaggaatcaatatagcaacagtttggatcagaccgtacagtttttttgtttttgtttttgtttttctgagatggagtctcactgtgtcacccaggctggagtgcaatgacgtgatcttggctcactgcaacctccgcctcccaggttcaagtgattcccctgcctcagcctcccgagtagctgggattacaggtgcctgccaccacgcccggctaatcttttgtatttttagtagagacggggtttcaccgtattagccaggatggtctcaatctcctgacctcgtgatccatccgcctcgccctcccggagtgctgggactacaggcatcagccaccgtgaccggctcagactgtactcttatagccatctgaaatacgttttctaggtagagatagattgtgtaagggtacagttgtgaggataacagaaacatggcagattatttaaaatcatcctgaacatggtgctttatctgatgaaagtgattgtaatccataggaaaatgtttcaacgtgcgcaagagttgcggcggcgggcagaggactaccacaaatgcaaagtaaggagcttcctccccgcagttgcaggatagttcagtgctgatgcagatgatgccacggctcttagactctctcaacattcaatttctcatgtgttggctttttcagatccccccttctgcaagaaagcctctttgcaactgggtaagtttgcttgttttccttgcttttgaacatagtctgccaggtcaggacatggatacatttttctccctacagctctgtgctcaagccctgcagagggagatggcagagaggaaggctgcctacaggcatcacagtcccatccctgttggtaaccgtgttgtgcaaaaacaccttcatccccacccagtggggcccctgatctaatattcaaagtgtcagaggttccatatttgtaatagcaaatgggccctgactgtaaattagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtgcacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaacccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagtcctgagaatcagagacagaacataaaaggcctggaaaacattctccaaaaagaagctgcaacatgtgtggacaatgggcttttcatgcctctcttactgtctcttactgtctgttgacctggtgcaagaaacatgctctggtgatggctgtgagggaggaatgaggatagacatagacactcctgtgtctcaaacatgcctctttattactctgttatgactctgtcttccctggggcaggaccccagcctgcctacatttgcagacagacacagtggcatgtggagacaacagtgtgtcccaatgacttttctttactccccagctgtcggcagtactcagtggaagggtgatatcatgacactgatactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagcggagcatcgtcattcttcaggattgccctgctggccctacctcacagctgaagctttaaaaaacaggatgggccgccagccacctcctccaactcaacaacattctataactgataactccctgagcctcaagacacctcccgaatgtctccttcatccccttccaccctcagtggatgataatatcaaggagtgtcctcttgctcctcttccaccctcagtggatgataatctgaaggagtatctcctggtccctcttccaccctctcctcttccaccctcagtggatgataatctgaaggactgtctctttgtccctcttccaccctctcctcttccaccctcagtggatgataatctcaagactcctcccttagctactcaggaggccgaggcggaaaaaccacccaaacccaagaggtggagggtggatgaggtggaacaatcaccgaaacccaagaggcggagggcggatgaggtggaacaatcgcccaagcccaagaggcagagggaggccgaggcacaacaattacccaaacccaagaggcggaggttgagtaagctgagaacacgccattgcactcaagcctgggcaataagaataaatccgtgggtcgaaaaaaagaaaaaaatcaaaaaacaaaacaaaacccacgctccaaaaacaaactaacgaagaataaataaataatataaaaataaaataaatactgcagtcctta

SEQ ID NO: 13280 - DNA, 5639 bp, Homo sapiens
cacagattccttggacatccctgagaggtcaatcatgaaggtcaacttggttttctccccctcatttgggttcagaatttaaagtccacacacacaggcagtaagatgattatagataaggacatcatcactcggtttcggatgttaaattgtctaggtgggttaggggtgatttgagatcacacaaccttgtgccacaaagaggaattcccaggccagagggagacattttattgccatgttatgatcttatcattgagttgaaaggcaatcttgtttcattttggattctttcttatgtttatgtcttataagggcactttgaatttccaagcaaataataattttgaattagcttttaatcattgacttctagcacagttatatgatcagaaacgtgctgtgtgatttgattgctctcaaatatattgagatttgctggaacaaaataagtcaggttaatttttgtaaatgtaccatgcttgcttaaaatgaatgtatctacatttgttcctgagatacgggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcgcccagaagcagggacagggagctggttggggaggaccagaaatcaggtttgtgaaggttccagagaggacctgtccttgcgaggagtgtgggagactgagatgggggaggggtcattggaatgatgcgggcgctacttggcattgtccattgtgaggcaccaccggggtcatcagggattggtggagagggagtataaagccccaggtttgctaagggagggcccagaccgaagaaggtttggcggatagcagaacctttttgtctccctctaattgctcctaagcctcacgctcccttgccccgcgtgtcctgttgcttccctgatcttctccgtgacctgtagctaaaccttccaccagcgcttgagaacttaatttgaaccggatcctttcccagacccctttcttcttctcctcctccacctcctccaggtgcccaacagccccccttctcctcctttcccttcccttacttccccccttccctcccttcccctccccctcccctccccttcccctcccttccccttcccctccccctccccttcccctccccctccccttcccctccccctcccctcccccgccccaactcagatccggccccggtccccgtccccttccctcccccctgccctaagccacctccacctctgtcctggccgcctcagggcaccctgaaaggatcaggacatgcggctgcgcttttggctcctcatttggctcctgctgggatttatcagccatcagcccacccctgtgagtagacgctggacccgcggggtttcttcctttttactgggctgtgtcacgcggcatgaaattacacagctcaggcctgtaatcccagcactttagggggccgaggtgggcagatcacttgagtccaggagttgaagactagccagggcatcatggcgaaaccccatctctacaaaaaattccaaaaaagattagtcgggcctggtggtgcgtacctgttatcccagttactggagaggctgaggtgggaggatcgcttgggccgaggagctggacgttgcagtgagctgagatggccccgctgcactcttgtctctaacaaacaaaatggaccaaaacaaagtgaaatgtcatttgatttgtgtcatctggtttgatgacttttttttttttttttttagacagagtctcactctgtcgcccaggctggagtgcagtggcaagatctcggctcactgcaacctccgcttccggggttcaagcaattgtcctgcctcagcctcctgagtagctcagattacaacgcctggctaatttttgtatttttagtagagacggggtttcaccatgttcgccaggatagtctccatctcttgacctcgtgatccgcctgcctcggcctcccagtgccgggattacaggcgtgagccaccgcgcctggccaaaatatataaccttaagtgtaagtttactaactttggaaagtacatacaccagcataaaccgaccccctttcaagatctacattattttatttatttatttatttttttgagacagtttctcccttgttgcccaggctggagtgcaatggggcaatatcagctcaccgcaacctctgcttcccaggtttgagcgattctcctgcctcagcctcccgggtggctgggattacagacatgtgccaccactcccagctaattttgtatttttagtagagatagggtttctccatgttggtcaggctggttttgaactcccgacctcaggtgatccgcccgcctcggcctcccaaagtgttgggattacaggcgtgaaccaccgtgcccagccaagatctacactattatgtcaccccagaaagtgaactctcagtcttcccagccagtctctttcttatcataggttagcttgcttattctggaatttcgcgtatacagatgcgtgccatgccataggtactcttttgtgtctgctttgttctgctcaacaccatgtttctgaaatcattaccattgttgtatggttctctaactccatcatttccatttcagactcagcatatgctgagttcaacctgttgaagggctatctctgtttaattcaccatcttgaaagaaacatttaaaattgagatgttttcaagaatatatagttaaatcctgaggaatcgatgtagaaatgttatcacaagctgtctgaacttactcaggggaagtcttcgtcttcactcacataagagtctactggaattaatatcaacaatcttagagaaatcccacactattcatgccattttcatgatctccaccttggtaatttttttttttttttttttttttgagacagagtctcactctgtcacccaggctgaagtgcagtggtgcgatctcggctcactgcaacctctgcctcctgggttcaagtgattcttctgcctcagcctcccaagtagctggaactgtaggcacgtgccaccatgccctgctaattttttgtaattttagtagagatgggtttcaccgtgttagctaggatggtctcaatctcctgatctcgtggtccacccacctcggcttcccaaagtgctgagattgcaggcgtgagccaccacacccggcccaccttgttaatttttaagcactaaaatttgatacttatttgtgaatgaagtaatctcttcattgtattttttttttttacttatgctgagcttcaaatgacaaagattcatataatccaagagagaagtattatttagagggattcttttaccatgtgatatataataaatgcatccaatgttatacatcaatttaaaaaacaagtaaataactttaaagaaaagataactactggccaggtgcagtggctcacacctgtattcccagcactttgggaggccgaggcaggtggatcaagaggtcacgagttggagaccagcctggccaagatggtgaaaccctgtttctactcaaaatacaaaaattagccgagtgcggtggcaggcgcctgtaatcccagttactcagtagctgaggcaggagaatcgcttgaacccgggaggcggaggttgcagtgagctgagatcatgccactgcaatctagcctgggtgacagagcaagactttgtctccaaacaaaaagaaaagataattactttatacttagcttgtcttagccatgagtgacgggctgcatgtggcccaggacagttttgaatgcagttcaacacaaatttgtaaactttcttaaaacattaggagattttggccaggtacagtggctcatgcctgtaatcccagcactttgggaggctgaggcgggcagattacctgaggtcaggagttcgagaccacctggccaacatggcaaaatcccatctccacaaaaaatacaaaaatttgctgagtgcattgtcaggcacctgtactccagctactcaggaggctgaggcaggagaatcacttgaacctgagaggcagaggttgcagtgagccgagagcacgccactgcactccagcctgggtgacagagtgagaccccatctcaaaaacaaaacaccaaacaaaaacaaaaacaaaaaaaaatggctgggcacggtggctcacacctgtaatcccagcactttgggaggccgaggcaggcagatcgcctgccaggagttcaaggccagactggccaacatggtgaaacctcatctctactaaaaatacaaaaatgagtcgggcatcgtggcagagacctgtaatctcagctactcgggaggctgagggaggagaatggcttgagcccaggagctggaggttgcagtgagccgagattgcaccactgcactccagcctgggcgactgagtggagcggaactctgtctccaaaaaaaaaaaaaaaagagtttttttttagatcatcagctattgttagtgttagtgtatgttatgtgtggctcaagacaactttgtttcttttaatataggcagggaagtgaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcggtgtcattgaccttttcattatttcaactattattattccaggttatcaatagtctggctgtctatcgtcatcgtgagactgactttggtgtaggagttcgagaccacctggccaacatggcaaaaccccatctccacaaaaattggataatttgataattatcattattgggtttctgagacgttacacatttaacgttctcttctgcacaagttgcctttgtgtgagtatactaactttctgtagaggtatacttgtaatcacaaataagaataaattatataaaacaattcacgtttctggacttcattatgaatatgtggttttacccaaaaaatcagggaaatgatttattagcataagaattatgaaaatgtctgccatttacattatgaaaattaaataggtcggtgtttgtttaatagaatgtcaacagagcttttggtcaaaaataagtttttttagcctttgtgctatttatcacaaatggagtatgaggtttcgtcacttaaataggaaattctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaaggg

SEQ ID NO: 13281 - DNA, 14258 bp, Homo sapiens
caacttagatccggccccggtccccgtccccttccctcccccctgccctaagccacctccacctctgtcctggccgcctcagggcgccctgaaaggaccaggacatgcggctgcgcttttggctcctcatttggctcctgctgggatttatcagccatcagcccacccctgtgagtagacgctggacccgccgggtttcttcctttttactgggctgtgtcacgcggcatgaaattacacagctcaggcctgtaatcccagcactttagggggccgaggtgggcagatcacttgagtccaggagttgaagactagccagggcatcatggcgaaaccccatctctacaaaaaattccaaaaaagattagtcgggcctggtggtgcgtacctgttatcacagttactggagaggctgaggtgggaggatcgcttgggcccaggagctggacgttgcagtgagctgagatggccccgctgcactcttgtctctaacaaacaaaatggaccaaaacaaagtgaaatgtcatttgatttgtgtcacctggtttgatgcctttttttttttttttttttttttgacagagtctcactctgtcgcccaggctggagtgcagtggcaagatctcggctcactgcaacctccgcttccggggttcaagcaattgtcctgcctcagcctcctgagtagctcagattacaacgcctggctaatttttgtatttttagtagagacggggttttaccatgttcgccaggatagtctccatctcttgacctcgtgatccgcctgcctcggcctcccagtgctgggattacaggcgtgaaccaccgcgcctggccaaaatatataaccttaagtgtaagtttactaactttggaaagtacatacaccagcataaaccgaccccctttcaagatctacattattttatttatttatttatttatttgagacagtttctcccttgttgtccaggctggagtgcaatggggcaatatcagctcaccgcaaccgctgcttcccaggttcgagcgattctcctgcctcagcctcccgagtggctgggattacagacatgtgccaccactcccagctaattttgtatttttagtagagatagggtttctccatgttggtcaggctggttttgaactcccgacctcaggtgatccgcccgccttggcctcccaaagtgttgggattacaggcgtgaaccaccgtgcccagccaagatctacactattatgtcaccccagaaagtgaactcccactcttcccagccagtctctttcttatcataggttagcttgcttattctggaatttcgcgtatacagatgcatgccatgccataggtactcttttgtgtctgctttattctgctcaacaccatgtttctgaaatcattaccgttgttgtatggttctctaactccatcatttccatttcagactcagcatatgctgagttccacctgttgaagggctatctctgtttaattcaccatcttgaaagaaacatttaaaattgagatgttttcaagaatatatagttaaatcctgaggaatcgatgtagaaatgttatcacaagctgtctgaacttactcaggggaagtcttcgtcttcactcacataagagtctaatggaattaatatcaacaatcttagagaaatcccacactattcatgccattttcatgatctccaccttggtaattttttttttttttttttttttgagacagagtctcgctctgtcacccaggctgaagtgcagtggtgcgatctcggctcactgcaacctctgcctcctgggttcaagtgattcttctgcctcagcctcccaagtagctggaactataggcacgtgccaccatgccctgctaattttttgtaattttagtagagatgggtttcaccgtgttagctaggatggtctcaatctcctgatctcgtggtccacccacctcggcttcccaaagtgctgggattgcaggcgtgagccaccacacccggcccaccttgttaatttttaagcactaaaatttgatacttatttgtgaatgaagtaatctcttcattgtatttttttttttttttttacttatgctgagctttaaatgacaaagattcatataatccaagagagaagtattatttagagggattcttttaccatgtgatatataataaatgcatccaatgttatacatcaatttaaaaaacaagtaaataactttaaagaaaagataactactggccaggtgcagtggctcacacctgtattcccagcactttgggaggccgaggcaggtggatcaagaggtcacgagttggagaccagcctggccaagatggtgaaaccctgtttctactaaaaatacaaaaattagccgagtgcggtggcaggcgcctgtaatcccagttactcagtagctgaggcaggagaatcgcttgaacccgggaggcggaggttgcagtgagctgagatcatgccactgcaatctagcctgggtgacagagcaagactttgtctccaaacaaaaagaaaagataattactttatacttagcttgtcttagccatgagtgacgggctgcatgtggcccaggacagttttgaatgcagttcaacacaaatttgtaaactttcttaaaacattaggagattttggccaggtacagtggctcatgcctgtaatcccagcactttgggaggttgaggcgggcagattacctgaggtcaggagttcgagaccaccctggccaacatggcaaaaccccatctccacaaaaaatacaaaaatttgctgagtgcattgtcaggcacctgtactcccagctactcaggaggctgaggcaggagaatcacttgaacctgagaggcagaggttgcagtgagccgagagcacgccactgcactccagcctgggtgacagagtgagaccccatctcaaaaacaaaacaccaaacaaaaacaaaaacaaaaaaaaatggctgggcacggtggctcacacctgtaatcccagtactttcagaggccgaggcaggcagatcgcctgccaggagttcaaggccagactggccaacatggtgaaacctcatctctactaaaaatacaaaaatgagtcgggcatggtggcagagacctgtaatctcagctactcgggaggctgagggaggagaatggcttgagcccaggagctggaggttgcagtgagccgagattgcaccactgcactccagcctgggcgactgagtggagcggaactctgtctccaaaaaaaaaaaaaaagagtttttttttagatcatcagctattgttagtgttagtgtatgttatgtgtggctcaagacaactttgcttcttttaatataggcagggaagtgaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcggtgtcattgaccttttcattctttcaactattattattccaggtcatcaatagtctggctgtctatcgtcatcgtgagactgactttggtgtaggagttcgagaccaccctggccaacatggcaaaaccccatctccacaaaaattggataatttgataattatcattattgggtttctgagacgtgacacatttaccattctcttctgcacaagttacctttgtgtgagtatactaactttctgtagaggtatacttgtaatcacaaataagaataaattatataaaacaattcacgtttctggacttcattatgaatatgtggttttacccaaaaaatcagggatatgatttattagcataagaattatgaaaatgtctgccatttacattatgaaaattaaataggtcggtgtttgtttaatagaatgtcaaagagcttttggtcaaaaataagtttttttagcctttgtgctatttatcacaaatggagtatgaggtttcgtcacttaaataggaaattctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggccggatggttgatgcttaaagagcaccctcttctgaggggagagggagatagatggagatgtaggccatttagaggggcagcaaatgatttttaggggaaatgaaagaggccaaggaacaaacaattggcctgagacaaagttcctctgaggtcatagggacgaggtgacaaactgccggaaggtgaagggcagaactgcactgcgtctcatgatgcagagaaagccccagagaatctcttagaactgccctccaagagaatcaatgaaaagtgtgtctgggcagggtaattttgaatgacatcattcaaagtgcatgttcccacttgcaactggaaagagatcagtatgtcaaaagtctgtacttggtaagaatttggctgctaagttgtgccataatttgtcttttgagccttttttcctttgggtaagttgagctctacattttgtcttaccattcatgacagtaaaaatgtggttttctgggggctgaacctccttctgaacaatgatccaagataaaagtactaataccacaatgcttttttatattcaagggaagaggaagtatgtttcagttttaccacctagataattacaagtcatttggcactgcctttcaagatatgtagaaaacagaaaatatatgagttatgaagatatctaggcacatttaacattctctatgccacttagtcctgaacagagaatttttggtataaattggaggaagctttttttttttttttttttttcttttctcacccccgaaacgagtctccctctgttgcccaggctggagtataatggtgtgatctcggctcactgcaacctccacctcctggcttcaagcgattcccctgcctcagcctctcaagtagctgggattacaggtgcccaccaccatgcccagcaaatttttgtatttttagtagagtcggggttttaccatgttggccaggctagtctcaaaacccgacctcaaatgatccacccgcctcagcctcccaaagtgctgggattacaagcgtgagccaccacgtgagccaggggaagtttttaaatttaccactttttaacagttccatttaggaaagttcagttgagctgctggacttggacaacttcgcacctctcatctttgtccttgtcatctagtcatctataccattacctcctaagcagggacatcatgggtgccatgaagcattcatgcgtgatggcatttctttgcttctcatttcttcatgtgtttgacatttctcctagctccaaactgggccagctacctttcctatgaaatctagtagtagctgtgggattgacgtggttgctcttttcatctttttagattacccattgcttctctcgaaatcctagtatatgattttttttttttatcctatgtgcagaaatcaggaaaaaacaaattctacaaagaatttgaaagatattatttcaggccaggtgtggtggctcatgcctgtaatcccagcactttgggaggctgaggcaggtggatgacttgaggtcaggagttcaagaccagatgggccaacatggtgaaaccccatctctactaaaaagacaaaaattagccaggcatggtagcaggcacctataatcccagctacttgggaggccgaggcacaagaatcgcttgaatctgggaggtggaggttgccgtgagccaaggtagcgccactgcacttcagcatggttgagagtgacactccatctcaagaaaaaagtcatttcaatgactacctcaggagattcataggtatctgacccacatctgagatgggatttgcattgcattttcgctatgatgagaacaaatatttaatatcttagaagattaaaagcatactgtgataatatggaaatcttggtgggaattcagtcattagtgagaatgttttgcgttaagttcaaaccagcctcaatgaagctgatgtgagggaagggaaagtgaactctgagtagagcagggacagaaggaagatgctccagtgcagatcaggaaggagcagggggtgaaatgttacaaattctagaactcagagagctgaaggtaattacttccttttcaagttgtgaaacatgttaacctgtggtaaaatacttataagatgataattaccatctaaccgtgttgaagtgtacagttcagttgtgtgaagtatattcatgtcattttttttttttttttgagacggagtctcactctgtcaccaggctggagtgcagtggtgggatcttggctcactgcaacctctgcctcctgggttcaagcagttctcctgcctcagcctcccgagtagctgggactacaggcgtgcatcaccatgctcagctaatttttgtatttttagtagagacggggtttcaccatgttgcccaggatggtctccatctcttgaccttgtgattcacccgcctcagcctcccaaagtgctgggattacaggcgtgagctaccgcacctggcctatttttttttttttttttttttttttttttgagacagagtttcaattttgttgcccaggtttggagtgcaatggcacaatctcagctcaccacaaccttttcctgctgggttcaagtgattctcctgcctcagcctcccgactagctgggattacaggcatgcaccaccatgcctggctaattttgtatttttagcagagacagcatttctccatgttggtgaggctggtctcaaactcccgacctcaggtgatccacctgcctcggcctcccaaagtgctgggattacaggagtgagtcaccgtgccagcctcatgtcattcttgtgtgtgtgtgtgtgtgtgtgtgtgtgtgtgtgtgtgtgtgtgacagagtctcattctgtcgctcaggctggagtacagtggtgtgatctcggctcactgcaacctccgcctcccagcttcaaacggttctctgcctcagcctcccgagtagcttggattacaggcgcccgctgccatgcctggctaatttttgtatttttagtagagacagggtttcaccatcttggccaggctggtcttgaactcctgaccccgtgatccacctgcctcggcctcccaaagtactgggattatttatacgcatgagccaccgtgcccagccgtcattcttatattattatttcctaggtgtctttcctgaagactatcttctggtctcgaaatggacatgatggatccacggatgtacagcagagagcctggaggtccaaccgcagtagacagaaaggtatggctctgttggagtccccatagtgtggaaatgagtttgccctggaaagggaaagaacagcttcttgacctcaggtttctcaccttctcctctcctcactctcaccaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagtaagatgtgccttgacacaaatactgttgtatgaaccatgtgccaatcaaagtagacaactgtaaagtccttgagaatattttctacaatatttgtggcaaattcagtgggctcaaaattgagtttgtcctttctgcttcattagtttaagctgtataattcctttcccttcctacattcttgtttgtaattttttcgggggaagaggagttgctagtactggcattggttttcctttctctcttttttttttttttcctgagatggagctttgctgttgttgcccaggctgtagtgcaatggcacaatctcagctcactgccttttggcttcaagcaattctcctgcctcagcctcccaagtagctgggattacaggtgcccaccaccacgcccagctaatttttgtatttttactagagatggggtttcaccatgttgtccaggctggtctcgaacttctgacctcaggtaatccacctgcctcagcctcccaaagtgctgggattagaggtgtgagccaccacacccagccttttttttttttttttttttaaattttgagatagaatctcgctctgtcgcccaggctggagtgctatggtgcaatcttggctcactgcaacctctgcctcccagtttgaagcaattctgcctcagcttcctgagtagcttggattacaggtgtgtgccaccacattcggccaatttttttttttttttttttgagacagagtctcactctgtcacccaggctagagtgcagtggcatgatcttggctcactgcaacctccgcctcccaggttcaagcgattcttatccctcagcctcttgagtagctgggactacaggcatatgccaccatgcccggataatttttgtattcttagtagaggcggggtttcaccatattggccaagctggtctagaactctggacatcatgatccacatacctcggcctcccaatgtgctgggattacaggcgtgagccaccgtgcccggcccaatttttgtatttttagtagagacaggggttcaccatgttggccaggctagtcttgaactcctgacctcaggtgatctgcctacctcagcctcccagtgtgagccaccgcacccagcctggattgttgaattcaatgcttgggtcacctccagattcattttcacagtctttcatgttttggtcatattacattgtattttgctgccatatgactgatctctttttgttaaatgtgagatacttgttaaaaaatatttagcaatgaattgaggcctagtggcatgttatcttgctgcagaagagatgggagtctacttctgggggatggtcacgggtcctccatacaggctgcaattgaggtcgtcggtgcaggctcagtccctagaaaggccaggtatttcctgtccacctctattctgatgcatgactcttctgggtctcaaccagagccagtggacttcagtacgggtcgctttcattggcagaccctcaatccacttgttttccatctaatcccacgcatgtgtgcaaaagctgctgtgcttctttgcatctcagtagttccttctggaattcagcaatgaaactcagggaaatggattccaaatgcgaggctgactttcgtcctgggtttccttcttctccatcttcacctcatgtctgtttactgccatgttagctatttgatgtattcaatcatgggttttatattctgtttggtgtcccccattgttctcatcggagatcagaagcttcagatgcacttatgtcaactcaagagtagaatgcttccttagcttccctccagagtcaggttttgtgtttctagttcccaagtgcacagcaggagtagtgatgtcctcactggcttctcatttgcattaaactgtgagcttctttagcgtggggacaggaccctgctcccattgcattctcagcaccacaccacacactccttgttggaggccactccagacagcatgtgctgaaggatgccctgtggtcagaaacaagttcattaactttccctttgaagtgttttcgcccctgtttcctagcgttctgggaattttacacatccttcctataaaaccaagtatcaggtgagatccttaggatcaggaccatgaatcaagtggtgtgagggcaacacagcaaacttaccctttttaggccatttcctttttctgccctcaaactctgtgaactgaaccttgttaaagtcagtcaacaccagggtggatggtttgccgttgtcacctattttcaggacataacaccctgacttaggagccattccgatcatttctaattcaatagatgcacccagcattcagattgccttttctctcaaccaggatctttaaagtcgatgacaagagttccagtcctgaatcatggcaaagtgcagtagtgaactgcggggttaatgacaccatattctggaaggatctctctatggctgatggtctcagttctggcatcagcctctgactgagaagcaggtctcacacaggaagagtcagatgaggagcaatcctctgcttccgatggagttagttgtgatgagttggtgaggtctggtttttcacactgaactaaaatgatctttcgctgtgtcaaacacaagactgaccccagacacacacatagtgcacctcatagaagcttttaatagtctttatatttactaaagaataggactaactatggaactatgaagatgagctggaaatgacaggtgacttgccagcaggccagagtgtgattttttttggtccctcaatgggaggtgtccattctcccttcggttgtgagaatcagttggttcatttgtgggaaggttgcaggggggatctttgaatcacagccttcagatgccagaagggcagagggaatcccacatggactggtggatcatgtgtgtgcatttctctcccttctaacctgaggaaactaagcatgaaagaatgtgagcacacagaaaaggagaggcaggtatcagaggcagaggaaaatgggaaattggatatgaaagaaatacacacctacaagtgagttcagaaactgaaccccaccctcctgggaaacgcccattggagtgttgtttataacctctgtacaatgtttagacccagtaaatgcagaaatagaaacaaatggtcagaagacctatcgtgagagagagagagagttcacaaaacagaaaacaaagtacctgaatatttaccagtgaccaaaagatgtgaagtagcaaaacgtctcctgaccccattgccagctagactgtgtggaaactcggttcataccagccattctaggggtggggtgagttgttgtcatccttaggaaagtgtgttgttgtaggatcaaccacatccttcaaaaggactatgcctgtttataagcccagctctttctgccctgtgaaacacggtaaggatattaatacaaagagaatacagctttatgataaaagatgctcaatgaaggatgaattagggatatactgagaatggggaaggaaactatcatctcagaagtcagcaggcagtaagcaagaggaggaatcaatatagcaacagtttggatcagaccgtacagtttttttgtttttgtttttgtttttctgagatggagtctcactgtgtcacccaggctggagtgcaatgacgtgatcttggctcactgcaacctccgcctcccaggttcaagtgattcccctgcctcagcctcccgagtagctgggattacaggtgcctgccaccacgcccggctaatcttttgtatttttagtagagacggggtttcaccgtattagccaggatggtctcaatctcctgacctcgtgatccatccgcctcgccctcccggagtgctgggactacaggcatcagccaccgtgaccggctcagactgtactcttatagccatctgaaatacgttttctaggtagagatagattgtgtaagggtacagttgtgaggataacagaaacatggcagattatttaaaatcatcctgaacatggtgctttatctgatgaaagtgattgtaatccataggaaaatgtttcaacgtgcgcaagagttgcggcggcgggcagaggactaccacaaatgcaaagtaaggagcttcctccccgcagttgcaggatagttcagtgctgatgcagatgatgccacggctcttagactctctcaacattcaatttctcatgtgttggctttttcagatccccccttctgcaagaaagcctctttgcaactgggtaagtttgcttgttttccttgcttttgaacatagtctgccaggtcaggacatggatacatttttctccctacagctctgtgctcaagccctgcagagggagatggcagagaggaaggctgcctacaggcatcacagtcccatccctgttggtaaccgtgttgtgcaaaaacaccttcatccccacccagtggggcccctgatctaatattcaaagtgtcagaggttccatatttgtaatagcaaatgggccctgactgtaaattagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtgcacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaacccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagtcctgagaatcagagacagaacataaaaggcctggaaaacattctccaaaaagaagctgcaacatgtgtggacaatgggcttttcatgcctctcttactgtctcttactgtctgttgacctggtgcaagaaacatgctctggtgatggctgtgagggaggaatgaggatagacatagacactcctgtgtctcaaacatgcctctttattactctgttatgactctgtcttccctggggcaggaccccagcctgcctacatttgcagacagacacagtggcatgtggagacaacagtgtgtcccaatgacttttctttactccccagctgtcggcagtactcagtggaagggtgatatcatgacactgatactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagcggagcatcgtcattcttcaggattgccctgctggccctacctcacagctgaagctttaaaaaacaggatgggccgccagccacctcctccaactcaacaacattctataactgataactccctgagcctcaagacacctcccgaatgtctccttcatccccttccaccctcagtggatgataatatcaaggagtgtcctcttgctcctcttccaccctcagtggatgataatctgaaggagtatctcctggtccctcttccaccctctcctcttccaccctcagtggatgataatctgaaggactgtctctttgtccctcttccaccctctcctcttccaccctcagtggatgataatctcaagactcctcccttagctactcaggaggccgaggcggaaaaaccacccaaacccaagaggtggagggtggatgaggtggaacaatcaccgaaacccaagaggcggagggcggatgaggtggaacaatcgcccaagcccaagaggcagagggaggccgaggcacaacaattacccaaacccaagaggcggaggttgagtaagctgagaacacgccattgcactcaagcctgggcaataagaataaatccgtgggtcgaaaaaaagaaaaaaatcaaaaaacaaaacaaaacccacgctccaaaaacaaactaacgaagaataaataaataatataaaaataaaataaatactgcagtcctta

SEQ ID NO: 13282 - DNA, 1905 bp, Homo sapiens
atgtgtgccaccacgcctggccaatgttaaaaaatcctttaacttttttgtagagatgcactcctggactcaagcgatcctcctactggtcccgaccaccagcctctttctgataaacatttacactttattatctgatgccatttctatcttcttccttgtcgtccagacatcaaagaattaggtttcttcagggttttctttttcaagtcctcattgttaaagatcactcacattagggccagacaccacgactcatgcctgtaatcccagcactttgggaggccgaggcgggcagagcacttgaggtggggagtttgagaccagcccggccaacttggtgaaaccccacctctactgaaaaacatacaaaaattagctgggcgtgatggtgcatgcctgtagtcccagccacttgggaggctgaggcatgagaatcgcttgaacccaggaggcagaggttgtagtgagccaagatcacgtcagcacactctagcctgggtgacagagcgagactctgactcaaaaaataaataaaataaatatcacttacattagatatacccaaggggcgttctatagagagttggaagcagtggttattgcaacaggggcacggaagtcatctggctatgccaggatgcccaggggatactcggggtgggtggcatggtgctgctggggactcatcgcacaggacgctctgattgacgcactgccaggagtagcgctctgtcttggggctgcagccggcctcctcagctcgagtgtaacaacagtcgtggccatggcagcacctgcggatgtcacatgggcaggacagcaggtgggtgaagctctctcctggccctcctctcttgccaggaccatgggtgactgaagacccccagggaggcacagcatcctcttatctaagttttttttttttttttttttttttttttttttttttaagagacagggtctttctctgtcgcccaggctggactgcagaggcacaatcatagctcacggcagccttgaactcctgggctcaagcgatcctcctacttcagtgtcccaagtagctgagactacaggcacacgccagcatgcccggctggttttttaatttgtatttcctttgagacagcatatctctctgttgctcaggctggggtgcaatggctccatcagctcactttagccttgaactcccgggctcaagtgatactgccacctcaacctcccaagtatgctactacaggaacacaaactccttttttaaattttttgtggatatggggtctcactatgttgcctaggctggtctcgaactcccaggctcaagcagtcctcctacctcagcctccccaaatgctgggattacaggtgggagctactgtacgcctggccttatctaagctgtttccctgaaaatccccgacttcgataatgattccattggccccaccatgccctgtcctgccttcctggctgtgcccaagcttggtccctgcctgcctgcctgcctcactctctgggtctcgagctcctgtgacacatgactcctctctcttcctggagtgatccaagccctgccacttcctgaccttgcccacactgtaccctctgcctggggcaacttcatgtctgcccattgtcccttaggcctcagcccaggcacaagcccctgcctccggaggtcatccaggcctcaccaggctacaccctctcgtaaaattggattccctcccttcagggcaggtttataatgaaatcctcctcagaggccaggtgcggtgacacgcatctgtaatcccagcactttgggaggctgaggtgggaggatcacttgaggccagggggtcgagaccagcctgggcaacataagagagactcttgtctctataacaaatttaaaaa

SEQ ID NO: 13283 - DNA, 858 bp, Homo sapiens
cacagattccttggacatccctgagaggtcaatcatgaaggtcaacttggttttctccccctcatttgggttcagaatttaaagtccacacacacaggcagtaagatgattatagataaggacatcatcactcggtttcggatgttaaaatgtctaggtgggttaggggtgatttgagatcacacaaccttgtgccacaaagaggaattcccaggccagagggagacattttattgccatgttatgatcttatcattgagttgaaaggcaatcttgtttcattttggattctttcttatgtttatgtcttataagggcactttgaatttccaagcaaataataattttgaattagcttttaatcattgacttctagcacagttatatgatcagaaacgtgctgtgtgatttgattgctctcaaatatattgagatttgctggaacaaaataagtcaggttaatttttgtaaatgtaccatgcttgcttaaaatgaatgtatctacatttgttcctgagatacaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcgcccagaagcagggacagggagctggttggggaggaccagaaatcaggtttgtgaaggttccagagaggacctgtccttgcgaggagtgtgggagactgagatg

SEQ ID NO: 13284 - DNA, 465 bp, Homo sapiens
gtggtatctcactgtggttttgatttgcatgtccctggtgactaatgatgctgagcatcttttcatgtccttattgaccgtacatatagttctttgagaaatgtcttctcagatcctttgcccatttttaaatgggattgtctttttttattaaagagccagagatctgaagtctttttgagttgtaagatttcttcatatattctagacagaagtcccttataagatacatgatttgcaaatattttctcccattctgtgttgtctttttacttttttgatattgtcttttggtacggaaagacacttattttgatgaagtccaatttatctattttttgtttggttgcttgtgcttctggtaacatatctaagtgggagccaggtgcagtggctcatgcctgtaatcccagcactttgggaggccaaggcgggaggtttgcttgagaccaggagttcaagacc

SEQ ID NO: 13285 - DNA, 1033 bp, Homo sapiens
tttttttttttttttttgagacagagtctcactctgtcacccaggctagagtgcagtggcatgatcttggctcactgcaacctccgcctcccaggttcaagcgattcttatccctcagcctcttgagtagctgggactacaggcatatgccaccatgcccggataatttttgtattcttagtagaggcggggtttcaccatattggccaagctggtctagaactctggacatcatgatccacacacctcggcctcccaatgtgctgggattacaggcgtgagccaccgtgcctggcccaatttttgtatttttagtagagacaggggttcaccatgttggccaggctagtcttgaactcctgacctcaggtgatctgcctacctcagcctcccagtgtgagccaccgcacccagcctggattgttgaattcaatgcttgggtcacctccagattcattttcacagtctttcatgttttggtcatattacattgtattttgctgccatatgactgatctctttttgttaaatgtgagatacttgttaaaaaatatttagcaatgaattgaggcctagtggcatgttatcttgctgcagaagagatgggagtctacttctgggggatggtcacgggtcctccatacaggctgcaattgaggtcgtcggtgcaggctcagtccctacaaaggccagggtatttcctgtctacctctattctgatgcatgactcttctgggtctcaaccagagccagtggatttcagtacgggtcgctttcattggcagaccctcaatccacttgttttccatctaatcccacgcatgtgtgcaaaagctgctgtgcttctttgcatctcagtagttccttctggaattcagcaatgaaactcagggaaatgggttccaaatgcgaggctgactttcgtcctgggtttccttcttctccatcttcacctcatgtctgtttactgccatgttagcaatttgatgtattcaatcatgggttttatattctgtttggtgtcccccattgt

SEQ ID NO: 13286 - DNA, 1625 bp, Homo sapiens
gagactgggttttgctctgtcacccaggctggagtgcagtggctcgatcacagctcactgcagcctcaacctcctgggcttcaagcaatcctcctgcctcagcctcccaagtagctgggatcacagatgtgtgccaccacgcctggccaatgttaaaaaatcctttaacttttttgtagagatgcactcctggactcaagcgatcctcctactggtcccgaccaccagcctctttccgataaacatttacactgtttattatctgatgccatttctatcttcttccttgtcgtccagacatcaaagaattaggtttcttcagggttttctttttcaagtcctcattgttaaagatcactcacattagggccagacaccacgactcatgcctgtaatcccagcactttgggaggccgaggcgggcagagcacttgaggtggggagtttgagaccagcccggccaacttggtgaaaccccacctctactgaaaaacatacaaaaattagctgggcgtgatggtgcatgcctgtagtcccagccacttgggaggctgaggcatgagaatcgcttgaacccaggaggcagaggttgtagtgagccaagatcacatcagcacactctagcctgggtgacagagcaagactctgactcaaaaaataaataaaataaatatcacttacattagatatacccaaggggtggtctatagagagttggaagcagtggttattgcaacagggacacggaagtcatctggctatgccaggatgcccaggggatactcggggtgggtggcatggtgctgctggggactcaccgcacaggacgctctgattgacgcactgccaggagtagcgctctgtcttggggctgcagccggcctcctcagctcgagtgtaacaacagtcgtggccatggcagcacctgcggatgtcacatgggcaggacagcaggtgggtgaagctctctcctggccctcctctgctgccaggaccatgggtgactgaagacccccagggaggcacagcatcctctaagatttttttttttttttttttaatttaagagacagacagggtctttctctgtcgcccaggctggagtgcagaggcacaatcatagctcacggcagccttgaactcctgggctcaagcaatcctcccacttcagtgtcccaagtagctgagactacaggcacacgccagcatgcccggctggttttttaatttgtatttcctttgagacagcgtatctctctgtcgctcaggctggagtgcaatggctcaatcagctcactttagccttgaactcccgggctcaagtgatactgccacctcaacctcccaagtatgctactacaggaacacaaactccttttttaaattttttgtggatatggggtctcactatgttgcctaggctggtctcgaactcccaggctcaagcagtcctcctacctcagcctccccaaatgctgggattacaggtgggagctactgtacgcctggccttatctaagctgtttccctgaaaatgcccgtcttgggtaatgattccattggccccaccatgccctgtcctgccttcctggctgtgcccaagcttggtccctgcctgcctgcct

SEQ ID NO: 13287 - DNA, 465 bp, Homo sapiens; identical to SEQ ID NO: 13284

SEQ ID NO: 13288 - DNA, 1625 bp, Homo sapiens; identical to SEQ ID NO: 13286

SEQ ID NO: 13289 - DNA, 6896 bp, Homo sapiens
atctgccgcggactgcagccggaagtgtcgatccctcagccagggcatggagctctcctgccccggttcgcggtgcccggtgcaagagcagcgtgcccgctgggagcggaaacgcgcctgcaccgcccgggagctgctagagaccgagcggcgctaccaagaacagctggggctggtggccacggtgggggacctggcacacgctcccattataggacagggaccccagggtgtgggagggtctctgcgaggtcggtaacccggagcatgtagggagcctgggcagacttctgcggtttctgggggcgcttggcgttagccttctcttcctctaggctaagaaccaatgttctctccttccgcagtactttttggggatcctgaaagccaaggggaccctgcgaccacctgagcgccaggccctgtttggctcctgggagctcatctacggcgccagccagtgagtggaaggggcacagggagaggaaaggagggagagtcctggcctgtggccgtgcacagagcttggagtcagacttaggttctatttggagtccgccagttagctcacctgtggccttggcccagggccttagcatgcccttgttctccatctgtacaatggggtaatagcactactattagtgctattctcatgaaaactaaatgaggtggtgcttgagtggttctagagctgcccttttgctgtccttgcccacacagggagctgcttccctacctggaaggaggatgctggggccaagggctggagggcttctgccgccacttggagctctataaccaatttgctgccaactcagagaggtcccagaccaccctgcaggtaacctggagatgacctcaaatcttgccccttacctttccccttcatctggagacccaaacttcatacatttcctgcatttatagagccctctgggtgctcagctctgtggtaagttccttgtagagaaacgagagtttctctcaggagcacagcttactgaaggctgggaatgtggatacagatgaatgcaatataaggagtggcttctctccctgcttccaatcctttctccctcactccaggagcagctaaagaaaaataaaggtttccggaggtttgtacggcttcaggaaggccgccctgagtttgggggccttcagctccaggacctgctccctctgcctctgcaacggctccagcagtgagtgaactcttgattccagccgcctctctcttttagtttgtatgactgctgccctcagctttgtgggatgccttggggtcgatcccaaactcttgcctcgaccctgagccaaattgcttctaaaaaccttttgcaagagtaaatgtgaacccattggagtacccagggtctgcagcctgaggccctcagctggaactgtggaactttaaattgaagtgagggggcctgtactagggcctgaggcacggtttctggaaaagtttcagatgcggggctggcctgggttagaatttctgtctctgggttaagcctgagttaagggctatagtcaggctgtctgtagcatcctccttgggttgataaactttcatcttccaatctggcctcctgaagtatggctagtctgccagtgactcttcagtgtgggatggaagagggctgtgtggtgtgagcctggttctgagtcctacatgaaagaaggggatacagtagccagaagcagatctttcctggccttcaattgaagtatgggtagagggtgatctgcacatcaggcagggggaattctgcctggctctgcttcccctcagacttcccactgttgaattccaggtatgagaatctcgtcgtagctttggctgaaaacacaggtcccaacagccctgaccatcaacagctcacacgtaggttcttgctcctcggcaacgcaggctggaggcttcctctcctgtattcctttctgattctgacctccaacaatgtctggtatgaccctatcttccactgacatgtatacagtgtccctactgctctgccttttcttcaagaagtcagaccctgaccctggtcccttccagaataacctctttcacaaccatggcacccaaagtcaaagttgtatggggagtaaggtgggagatgttattccaggggctgcccgactgataagtgagactgcccagagagtccatactattggtcagaaacagaagaatgaccagcaccttcggcgtgtccaggctctgctcagtggacgccaggcaaaggggctgacctcaggtagcttgcctacttccccttcaatcctcaactgccccatcttttatttttatctaactccaaatgccgaccagctgctcttttcttactcacccttcttcctgtactgacccagcacataacccctattttctcagcctccctttcctcttattcccatgtatcttgaagctgcaccagaataacagcgctcccatcccccagggcgctggttcctacgccagggctggctgttagtggtgcctccccatggggagcctcggccccgcatgttcttcctcttcactgatgtgctcctcatggccaagcctcggcctccactgcacctgctgcggagtggcacctttgcctgcaaggccctctaccccatggcccagtgtcatctcagcagggtctttggccactcaggaggcccttgtggtgggttgctcagtgtaagtaataggtgggaaccctagacccaaaatatgtctcagatgcttatgggctggtttatctccctggtctgggtcccttttcataggaacagagccatctacattgagagaggatagctggggctcgggcttcatacctagtcattgtctcatccctgaattagctccatggaaacagcaagggcttcagctttagcctggacctttctgagccatgcgctaagaggtggtctctctctagctgtccttccctcatgagaagctactgcttatgtccacagaccaggaggagctgtcacgctggtaccacagtctgacttgggctatcaggtaagttgtgtcttcccccaggaagggtgctgtgatgaggcccacaagcaggaaatatgcagttcctgtctcatgccctacattggtctggcacaccccagccaccaacccccagatgattttgtctgaataaagcactcataccagtgcctgaactgactgtcttctctccacagcagccagaaaaactagaggaatcttatagattccagaactcaggatacctcagggataggtcacagccaagagtacaaaggaatcttcagtactgaacaaaacagaacccttcatgatttgacaaaggtcactttctgtttgcctggaccaagctactccagatcatctgaccaactcttaaaaatcacggccaggcacagtggctcatgcctgtaatcccagcactttgggaagcagaggtggcaggatcattccagcccaggagttcaagaccagcctgggcaacacagtgagtgagaccctgtctctatttaagaaaaaataattaagaaattttattaaaaaagaagaatcaggaaaccaagtccaacccaactaaacctcaaatgaaccagcccctaacacagatgaggggatttgggactgataagctctgtgctgtgtccatggcccgtcatttatcaaggctgcagctttgtaaatgtggctatttttatgttgtgtatagtttctatcatttatttttccactggatttgagtaaagttttttttcttttttttgggaaagacccttctgtctcagttttgctatgagaaaagggatttttgggccctgaacgcgggcatgctggtggcctcaggaatacgaggaaaagagctggagctccctctatcttctctgctgtcacactggaaggcagcctctttttgtcctaataaggacagctcttcaagaaggcccagttgtccttaggcacctagtatgggtgtgtacaaccaactaggatcgaaaaaacacacaggagcactccatcatgaaaacagactttgttttagtcgaccttcagctgtcgtccctccttcccagccaaggctgtgactggggccctttgccacagcctggctgcaccttctccgtagtccccgccccacctcccaggaagtagctaggttccatgtctctgtgctccagtttgtgggctcctcccaggcctgactgtcaccaatctcctcctcgtcctcctttaaacagaagtcctcaggaagaggtctgctggcctctgtgtggggagagatcaggaatgttccagtttcagagactttgtctccacctccagcagactcgcctcccgagccttcacctggttctgaagcctccatatccttgtccggcttgctatcttgcagcagctcgtggatggtccatagcttcatgttcagaagctcctgctgggctccagccagagtagtcacactgaagaaatgtccactcagtggctcccaacctatgtccccattcctccctcctgccacaaattccccaaaaattcacagaatcattgctctcctcaccgctcaaaaagggggtccagctgggccatcaggttgttcaggtgctgctctgtctgggccagctgttgtgtcaactgggccagctgttgctctggggataagggaaaaaagggggcagaagtggttatgtatcttctgctgtcccctaaactcccccgacccagcacagacttctgctaaacccacctgactgcagtggctgctgcttgcttgcctcctcgtggagaaccgcagtttcatctttcccctgttgtggaagaaggaaagggcagtactgaagcaacaaggttctgctccatcacctcagtctccagagccagccaagagagagtgcaatttgagatggagacagtgattgggtttttacctcagagaatcacaatcctagtctatctagctcctcacccagcatatgaagcgacgtcctatgtcccacacatggtcagtttgctgaaacacctccaggaatgagcaactccctccggtttgaaaaaagctctggtggctgagtgctgtggctcacacctgtaatcccagcacttcgggaagccaaggtgggtggatcacctgaggtcaggagtttgagaccagcctggccaacacggtgaaaccctgtctctattaaaaatacaaaaattagccgggcgtggtggcaggtgcctgtaatcccagttacttgagaggctgaggcaggagaatcgcttgaacctgggagccagaggttgcagtgagccgagattgcgccgctgcactccagcctgggtgacagagcgagactccatctcgaaaaaaacaaaaactttggttgttagacagttcatgcacaaagccaaaatttgtcctttatgtatcttctttccatagtgcttactggagccttccaaaataatgtctcctcaaggtgacagcccctcaggaatttgaaggcaatggtcacaccctcacccactttcctgagttttttctggtttattaacgtcagtctttacagtcagtgctcattgacggtggttttctctggttgtttcctgaacacgtagtgctcttaaagcaatgccctgaggagaatacaattctccaggggcattctgattggcaggtgaagcacagtgccatgttcccagcactgatttgggaagtggcttgtcacatcccacagtgaactcagtcaactggaatgcctaactctctttcataagacctcctgctacattatgtttctcccagactgtactcaggtccaagaacagaatttactagtctatccttctcaaagttcatcattaaattcagtcattcatcctagcctgtcacatctacctggggtcattattagctatctcttctagtttcatatatctaaactggttccatcggttctattttataatgcaagtacgtaatagggtcacggctaaagacacagccctggaaggtactgtttttcaaaatgtactgtcaacttacatttcagggcctcctcccaaggagaacatgagaccacttcatatctggaactctagaaacactggctgcagcaatcaacctcctgtgccaaggctggccccactcttgtagcatggacactgctagctgggttcaaatcccagctccagcagttgccagcgctgggtgacctcgagcaagtgactactcctcactggattgtaggagaactaaatgtgatagtcattatttacagttcaccacacgctcttcacatccgttacctccctggatcctcaaaataacctcataatattggaaggccaacggactactgtctttattttacagacagggaagctgtgtcttgttcttggtaccctggcacccccatgggagattcgggctcaggggatccccacgcccggcggtcccgcacctgcaggggcacccctacccccggccgccccgtacctgcaaacacttgtacagcacaaaagccgcgacggccgcggtgtacagcgcccccagaggcagcgacccggcccgggtccgctcgcgttgatccttgagcggtggtcgccgccggggttccgtggctccagagccggggtgggctgcgttccctgcggagggaggatacaggcgagtcagccgagctggggcctgggacccgtgcgcagtcccagccctcctccagcagccctagctggtacctgggtgtgcccggaggtcgggattggcgcggtctcctaggaccccggacagcgcagacacaagcagcagccccaccacacccaagagcgaaactgcgcccgccattgccggcccacgggtggagggatcgggcgggcggtgccgaagcggtccggcattggccgg

SEQ ID NO: 13290 - DNA, 258 bp, Homo sapiens
gctgaaggcctgtatcctaggctacacactgaggactctgttcctcccctttccgcctaggggaaagtccccggacctcgggcagagagtgccacgtgcatacgcacgtagacattccccgcttcccactccaaagtccgccaagaagcgtatcccgctgagcggcgtggcgcgggggcgtcatccgtcagctccctctagttacgcaggcagtgcgtgtccgcgcaccaaccacacggggctcattctcagcgcggc

SEQ ID NO: 13291 - DNA, 7914 bp, Homo sapiens
acgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttcatcctcatccccttccacgccctctggcctttcctcggttccttcctcccccatgtccaggaaacctcagaaattgaaatccagcaaatctttgaggcccaaggagtcttctggtaacagcactaactgtcaaaatgccagtagcagtaccagtggcggctcaggaaagaaacgcaaaaacagttccccactgttggttcactcttcctcctcctcttcctcctcctcctcttcttctcattccatggagtcttttaggaaaaactgtgtggctcactctgggcctccctacccctcaacggtaacatcttcccatagcatcggcctcaactgtgtgacgaataaagcaaatgcggtgaacgtccggcatgaccagtcagggaggggcccccccaccgggagccctgctgaatccatcaagaggatgagtgtgatggtgaacagcagtgattctactctttctcttgggccattcattcaccagtccaatgaactgcctgtcaactcccacggcagtttttcccactcacacactcctctagacaaactcataggaaagaaaagaaagtgctcacccagctcgagcagcatcaacaacagcagcagcaaacccacaaaggttgccaaagtgccagccgtgaacaatgtccacatgaaacacacaggcaccatcccaggggcacaaggactgatgaacagttccctccttcatcaggtaggaaatggactgtgagccccatgggaatgcccatttcttctcccttaagatcttttgtcagctcagaaatgtgtttggttgggttggttggttggtttgtaaacagatattcagcttcatggtgtcttcttaaaaaaaaaaaaaaaaaaaaaaaaggttcacggccgtatgaaggtaaaacaggctcttctgccagaatttctggtgcctttggaagatgttcttcagtaaagaaactacagtaatgcatttttagtagagctgcagaaagcatcggttgtgacagcaaaatcataattggagggtagcccctttatgaaatagccagtaatgtgttatcccagtgctgtgaagtgtgtgccattcgaggctttaaggaaggaagcaggcattgtttcctggatagtggttctttagtatgttccgctgaggaaagctgcgctaaaatcaaactgatctagaaaggggtgatttaagatttaaaatgaggctgggtgcagcggctcacgcctataatcccagcactttgggaagctgaagcaggtagatcacttgaggtcaggagttcaagaccagcctggccaacatggtaaaacccccgtctctactaaaaatacgaaaattagctgggtgtggtggtgcacgcctgtaatcccagctactcaggagggggaggcaggagaactgcttgacacgggaggcggaagttgcagtgagccaagatcgcgccactgcactccatccggcctatgagactatgtctcaaaaaaaaaagagcatttattatttttccctctcaaaagaatttcagatattctggttaaatctcaccccatattttctcttcccgtttttgagggaggcaggaaaacaggattcagtatgggcatagcagaagactgaaatctcattccaagctcatagttaaaaagaagtctgcatatgaacccatcagtagagaagtggctaagtggttgtgggattcataattaaccatgactttctctcttaggctgtatttttgtctcgtcccagctcttctgcctgttactgacctcacctgtagctgtttcttccagcttcctttgctctaacttccagctcatctctcatcttgttattttattcatcaggatatctcctcaccttgcttacgaacaggaatttcagcaacatcaccccagagccctgacttaaaatgtgaggctctttttcatgattttttttccccttcctcgtcttcagaacttaactcaaatgccagccgggttaggactttttcagaaaataccaagaagtttcttagtattttcgtagtgtgatataattttcctctaatatttgggtgaattaacacccattgccaaaggtatggggaaaatatttgtgaatttaactagctgcatgcattatgggttattatatgttgtttggcattctgatcatgggattcctggacaaatgagaagtgtgcttttccttcttggtttgtagttactcattacagtttataagcataacagtccaatataaacacagaagacatggtgtgccgattcttcaacgcaccgtctttgagagagacatgatccccacggaaggggcattccattgtgctgtaatgtccatctcacatctgtattagtgagcacactgtcttcatttagacaggagtgtagatcttaatgcccacaagtaacaaaaaggacagaaggggggggggccaggtggggcacagcagagattgacagtgcctactagaaattggggggacatggagcagctgcttccagacatttgttaccagttttaaagagaggctgcagatctggacttgcatgtgaaatttagttgagatatatgtgtgtgtgtatatatatatgtatacacacacgtatacacacacacttttttttctcttcttaaatctggtatagcctatgtatctgtgggccatctttggctcatgacctgccattttgccacctttgatttttaccatgtagtggcactatgtcttactagaacaacacagacagcctaactttgggctttttccttaaaatcagttaaaatcagtttccacttaagtttgtgtttgagagagattttctctgtgcagaggaatactttttattatgctacacaaatcctggggcaagagcaggggtgcttgcttagagatcaaaggatcattgaaccccaagaagtattgcacatttttatgtctttgttcatttatcgtatagctttcataagaatctcaaagggactcgtgaccccaaaatgctttaaagaatgctgctgttacaaaagtagggacctctacttgctgttccttgtggagctgccattaaaacaaaaataactgggctagttgaagttttctaaacaaggggatgaagagtgggacatgctgggaagcctaggagatgatggggttgggtaggcacccccaagagtctgttcatggcctgtgccaccaaagatgtaaaagcccactgtgaatgccagagtttcctcctccccagcatgggcactgccttgagtgcgaactgtcacacctgtgtgtgctagcccttgaccttgttcccttctcagttaacaacctggaataccttcaaggacacaaaagcactggaataccttcaaggacacaaaatcagtaaataaaaccaaaaggcaaacataagagccttttctctaagttagaaacccaggcctgcaactcttctagccagttggctagaagtgaatctttgcaatgattgtgcccagtagtagtgaaggcatttgaaagctaagaacaaaatctatagctgactgttcctggtgtcactcagtcaatggagactttagtagcgtgcagcctttggaatattcttgtttagaatcaatagagtgcagtgtacaaacgcttacttaccatttcattatttccccaccccctcttttttgaaagccaaaggcacgtccctgacagctgaaaatagcacggggaggaataatgcggacacttttgaggacaagttacacctccactcagcactctggactccacgatgcctttgagtctgttttcccaacctcctgtgggcctcaagggtagaaacctgccgggctgttgttttaacgaggatttccctgaagctatgtctctagcagtgagtactcataaaggacactggatcaagttcagccaccgaattgcttttatcagtgttaaagtggtctgaactgcttgctaccaatctgtgagaagtttttgtttttgttttgttttttaacttgcagtatatcacagagccactcttcaagtagattggctgggcaaaagaatgttttggcaagagcgttactgtagacctttctccctccttccttttactaccatttttttttaacactgtcatctgtaggtcactctccagcagttaggcaccttaactggagaccagaaaccttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtataaatcattttggaggcttacttttcatgatacaaaagcaattctgtgtgatttttttttttaagaagaaagaaaatgcaagctagttttgagaaaggaaggccaaattgggtcgggggagggtgggagtgaggaagttaaaatcactatagggagaaaaaacttttttcaagatttccaaagagatgaaattttcttaatccttttaagttttcatagtaaacagtatggcagattgggttggttgtcctacctggtctatttttaaaagtcaccttttaaagtgacattattagatacacttaaatgtttccaaggcactctctacattacccttgtttttctctttggatactgtcctgggactaagtgtagatttctgcttcaagcacttctggcattgtgtgtttttgtatgcactccccttcatgccacttcagatgtttatttggatgtggttggggacgagagcagacaccaaggaaagggagttggagagaatgtaagtcctgacctgaaggtcttttgtgatgcatgtataggattgccctgacacacaccctcctttcttgggattataccagccatcttcctgagagttttggagcctctaggatattttttctagtaccccaccccccacccctaaagaaagaccttaatatgttaaaacagcattgcttggagaaggtgtcattgaattccgggacgagccggagcctttaaatgggtgcttccaccactacaggctcctgacacgagtaacaggcactgttgcttagaagaacacacgaagttgccgaacacagggtaaaatttccaaggcgctgatcgttgccctggccagggcctgatgagagccagtcagtacattctttttttcctacagttcttgggtttcaaacttcagtttcagggaatttcaagtcaacaacaggtagaatgaataaacttggttaccagcctaataatgtgaattgctacagaattattcttattatgtaagaaaacaaaaactttatgcagatactttagctataaattgatgtaaaatactgatttttttaaaggaaggagagaacagtatcttgttcaattattatgcaatcaatcagtaaatgtttttaaaatgatactacaggagagcttagtaaggagagggcatggatgggccagtttggcatagttgggagaaatcagtctggtttccatcccagtcggggaagagagaggtgagagggaatcagaacgtacctagttgattccttggtgacaagtgcaatggggtatgggtagaatttattttcagagccaagaggacttgatggttataaataaagttgcctttagcaatggaatttacagatcgatcatgttgttccgaaagatgtgaataggatccacaataacaagttgattcagactaatgtagatatttagattagcaagtattgaacatttgatttcttagactgaggttttaaatgaatttcattatttctcccggtaatacacagagcatcgggattaggaaattagccattttggattctgtctgccacaaacagacctattctaaacagtgctattaaattttagactgttgttcaaatattttattttctcctaaactactttttatggtgatgaataattaagaccatttaaaacacgggagtacaagtatttttttgaattaaattaacttgcaaaaaccaaatttgcagtggttgggttgtttctagacagactttggtatcaatttaaaaccaagataatttttatattctttccaatagaatttcatgacaactcctgcagttttcttaacctacaaaaaaaaaaaaaaagtgctgcaatgatgaacaaagaattatacaaaacctacttttgtatctttattttggaatttcttgttctattataaatatggaagtatccctatttcagaagacatattttgttaaaaatgaattgtacatatttaaatatgtatttttgcacaggtctttttttctgatatcctgttttggtacaattgagatcatctagtatttatttattaattaataaaagtaaatacctttttataatttgaagtggttcactgccaagccaatagttctagaacctgcctcctttacagttttaagggatgcctctgttctgtgaaaagtctttgtcccttttagtgtctcgggagtggattcatacagatgaagtgggcattgcttcttcctggttgcctggtttcccgatagactacatgtaactaagtgacacactgcttttcttttgttagtattttatgtgtgggagtatgtgactgcgtgtgtgtgtgcctgtgcgtgtgtgtgtatactcagcacatgtatgttactatgtgatgtggtttaaaactaatggaaaaaactgaaagtgcctgaaactagttttaagcttagacagaatctctttaaaaagacttgaatgttcagttgaacttttggagtttgctttttccacctaaatattgtttctaaaattttaggggcggagttgaaaaccaccaatgctggtaattttataaggtattttaaaattaagacctcttggttcatagtaattcaattggtgatggattgcctggtggcaccaagggttacagatctttttgtcagccagcaacttacacgatgtgtccgttttgttattcactcatgaaatacaatttaaaatatttaaaatattttgtattccaaaaatataatacaaagaagtacctctgagaacattgaaaaaaatgtataatttgaaaaatgtaacttataagggcagctgtcttcctgcaagagttctgttgccaaggaatttcttaatgtcgctcattctgtccagggggtttggggcgattgggctttgaaaaaatattcttaaaagtttgtttagcagaaaataatcacttttacattttgtgcaaaacattttacattttcagataatttaaatgagcactacatactgtcagtgtgaatgtagggccttgaaagcattttgcttttttttttttttttttttttttgagcttggttataaaagcaatctcctgtgttaaaaacgtgtgaatagtttgataatttgtacacataatcaagagcatctcagctggactttgtgttggctgctgtatagaacatgaacaaatgtcaagggatagaaaattactttggatatttaaaagagaagaaatatatagtctatttgttttgtaacaagtttctgtaaataaaataatttatactatttataagaaaa

SEQ ID NO: 13292 - DNA, 3808 bp, Homo sapiens
agtactcataaaggacactggatcaagttcagccaccgaattgcttttatcagtgttaaagtggtctgaactgcttgctaccaatctgtgagaagtttttgtttttgttttgttttttaacttgcagtatatcacagagccactcttcaagtagattggctgggcaaaagaatgttttggcaagagcgttactgtagacctttctccctccttccttttactaccatttttttttaacactgtcatctgtaggtcactctccagcagttaggcaccttaactggagaccagaaaccttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtataaatcattttggaggcttacttttcatgatacaaaagcaattctgtgtgatttttttttttaagaagaaagaaaatgcaagctagttttgagaaaggaaggccaaattgggtcgggggagggtgggagtgaggaagttaaaatcactatagggagaaaaaacttttttcaagatttccaaagagatgaaattttcttaatccttttaagttttcatagtaaacagtatggcagattgggttggttgtcctacctggtctatttttaaaagtcaccttttaaagtgacattattagatacacttaaatgtttccaaggcactctctacattacccttgtttttctctttggatactgtcctgggactaagtgtagatttctgcttcaagcacttctggcattgtgtgtttttgtatgcactccccttcatgccacttcagatgtttatttggatgtggttggggacgagagcagacaccaaggaaagggagttggagagaatgtaagtcctgacctgaaggtcttttgtgatgcatgtataggattgccctgacacacaccctcctttcttgggattataccagccatcttcctgagagttttggagccctctaggatattttttctagtaccccaccccccacccctaaagaaagaccttaatatgttaaaacagcattgcttggagaaggtgtcattgaattccgggacgagccggagcctttaaatgggtgcttccaccactacaggctcctgacacgagtaacaggcactgttgcttagaagaacacacgaagttgccgaacacagggtaaaatttccaaggcgctgatcgttgccctggccagggcctgatgagagccagtcagtacattctttttttcctacagttcttgggtttcaaacttcagtttcagggaatttcaagtcaacaacaggtagaatgaataaacttggttaccagcctaataatgtgaattgctacagaattattcttattatgtaagaaaacaaaaactttatgcagatactttagctataaattgatgtaaaatactgatttttttaaaggaaggagagaacagtatcttgttcaattattatgcaatcaatcagtaaatgtttttaaaatgatactacaggagagcttagtaaggagagggcatggatgggccagtttggcatagttgggagaaatcagtctggtttccatcccagtcggggaagagagaggtgagagggaatcagaacgtacctagttgattccttggtgacaagtgcaatggggtatgggtagaatttattttcagagccaagaggacttgatggttataaataaagttgcctttagcaatggaatttacagatcgatcatgttgttccgaaagatgtgaataggatccacaataacaagttgattcagactaatgtagatatttagattagcaagtattgaacatttgatttcttagactgaggttttaaatgaatttcattatttctcccggtaatacacagagcatcgggattaggaaattagccattttggattctgtctgccacaaacagacctattctaaacagtgctattaaattttagactgttgttcaaatattttattttctcctaaactactttttatggtgatgaataattaagaccatttaaaacacgggagtacaagtatttttttgaattaaattaacttgcaaaaaccaaatttgcagtggttgggttgtttctagacagactttggtatcaatttaaaaccaagataatttttatattctttccaatagaatttcatgacaactcctgcagttttcttaacctacaaaaaaaaaaaaaaagtgctgcaatgatgaacaaagaattatacaaaacctacttttgtatctttattttggaatttcttgttctattataaatatggaagtatccctatttcagaagacatattttgttaaaaatgaattgtacatatttaaatatgtatttttgcacaggtctttttttctgatatcctgttttggtacaattgagatcatctagtatttatttattaattaataaaagtaaatacctttttataatttgaagtggttcactgccaagccaatagttctagaacctgcctcctttacagttttaagggatgcctctgttctgtgaaaagtctttgtcccttttagtgtctcgggagtggattcatacagatgaagtgggcattgcttcttcctggttgcctggtttcccgatagactacatgtaactaagtgacacactgcttttcttttgttagtattttatgtgtgggagtatgtgactgcgtgtgtgtgtgcctgtgcgtgtgtgtgtatactcagcacatgtatgttactatgtgatgtggtttaaaactaatggaaaaaactgaaagtgcctgaaactagttttaagcttagacagaatctctttaaaaagacttgaatgttcagttgaacttttggagtttgctttttccacctaaatattgtttctaaaattttaggggcggagttgaaaaccaccaatgctggtaattttataaggtattttaaaattaagacctcttggttcatagtaattcaattggtgatggattgcctggtggcaccaagggttacagatctttttgtcagccagcaacttacacgatgtgtccgttttgttattcactcatgaaatacaatttaaaatatttaaaatattttgtattccaaaaatataatacaaagaagtacctctgagaacattgaaaaaaatgtataatttgaaaaatgtaacttataagggcagctgtcttcctgcaagagttctgttgccaaggaatttcttaatgtcgctcattctgtccagggggtttggggcgattgggctttgaaaaaatattcttaaaagtttgtttagcagaaaataatcacttttacattttgtgcaaaacattttacattttcagataatttaaatgagcactacatactgtcagtgtgaatgtagggccttgaaagcattttgcttttttttttttttttttttttttgagcttggttataaaagcaatctcctgtgttaaaaacgtgtgaatagtttgataatttgtacacataatcaagagcatctcagctggactttgtgttggctgctgtatagaacatgaacaaatgtcaagggatagaaaattactttggatatttaaaagagaagaaatatatagtctatttgttttgtaacaagtttctgtaaataaaataatttatactatttataagaaaa

SEQ ID NO: 13293 - DNA, 19480 bp, Homo sapiens
  misc_feature (4316)..(4316): n equals a,t,g, or c
tgtttgcaaataaaccattctgataaattatttttgttgcttaaaataagaggaggaaccgctgtgtgttagcaagaatgtccatacctgatatgaaagagtcatgttggcttcagttcctactgccctgtggacttcccattccctccttacttgagtcaaccatccactcagtactttccacaaatctaataatgaggtgctctctgtaggtaaatcctttcactatggcttgtcctcaaacctcccaagaaaaggttcaactgctcaatctcttaacctttttaattccattcccttgcaggtatcccggccctgcataacaagatgatcccaactcaaggaaaggggtttagcagtgttggatcttggcgtatgtgggatttaaccaggcagaaaggcagacaagagtaagattctaggcagagagagcaaatgcgtcgagcatgggtatgaacatgtgagggatagagaataattctgcaggaagtttgctggatggaagggccttatagggttagaaaagctggtgtcagattgtcaaggactttgaatgtcatggggcttctcttccaggaacacatgggatcaggcttagattaacccaaatgtaattgtcagagcccagagatatttcatggtccagtcctagcactgtgcagctgccaaaagtcaaagccattcaaatctgtactgaaaactgtggaaaagcaaaggagcacttaagtctctttccccatgtcttgcattctcactctcttttgcttcaaagatctgtctttacctgcccctgtccccagtcctaacaaaaagcactcccctaaatcaactcttaagttcctctcccttctcactcctttcttagtctcctctttctgtaagaagttcttgctcctgttgttaatggaagttaattaaagtagtatttcaccttgtaaggctgtaattcttggcacttgttatcctcattttctacatccaaagaccatggaccagaatatctcttaggaggtaagggagagtgaggctatcagccaaagaaaaagtctccagggggaaggggagaatcacttataatttaatactttgtggaaaaaacatctctgccacctatggccctccaataacaatggaagacagaatcaacaggtgagaaccttgggacaaaaataagttacaaagctgttgtaatccaggtaagagctattaagtttccaaacgaaggctgactgtgaggataagtgatactgatttcagaaatctttaaaaagtagaaccaacaagccttgaggtctaactctgttcaacattaaagggaagagtgagtctaagaagacttcaggtttctagcttggccaaaccaattgagctttaagtgaaatgtgcgatatggtaacagagaaggaaaaagacataacgatagatttgagctgctggtgggaaattctggtttagtgcccagctggctgtacaggctggttggactttaggagggaggtttgagctggaaaataaagatggagagttgtctttcagttttagatcatcagtgaggtcataagggtagatggagtttacctgggaaaattaagtagctattcgatttggcttattattatgttaaaataatacttctctagtgaagtacttaatatgccagatactgtgccaagcattttatatacatcctctcttttactaagccctcatagggcaggtattttgattccaatcatactgattggaactcctaagaaggtatcttgcttaaggtcccacaacgaataggtggcagatccagggtaattcaggtctgtcagaacagtgattcttaattttttccctcctcagactccaggagtcacatgaagttatgcatcctgtctgaccgaggcacaggcacaccacatttttatattccgcttccaggatatcacaaacctgaagcccatcctccatggcccagagagaaaacccaggacaaaaccttggagaagactattttcatgaagacaaatggagaaggagcagtagagtaaaaagagaggtaagggaaggcattgagatggtttacagggttagatgttttgagtcaatcccattataattaccaatgctatctacctatttagttaacgttttattgccctgctgttttctccaggataattggaacagcatgtattggttgggtggaaaagatagaacttgagcagggagattgccaaagagtgaagatgtggctgagtgattgatgatggtctgaactgggtattcagggaagagaactagaagccaaccatgtagaatctatgcaggtgctcttaagacattggtttgactggaattatcttcttgttaggtcttaggaatctccttccaggtaactttttctatgattagacaattgatttgttcagggtcacagagcaaagtccacatttaattccacatggccaataaaagtgaggggctacaaggtgagatccaggggccagagttatcaaagtgatacagcacttttaggaataggacagggaatggaggaattggaattccagtattactttcaaaagcagaactggccagaggaattggaattccagtattattttcaaaagcagaactggccagaggtgcttgtgattcctgggtggaaaccatggcagtggacagaagcagcatggaggaaaagagcactggaattcaggctgaggaactgtgaagccaagggtgttgtataggttgtccatttcaaattagggttgcttggttctgggatgatttgcatggaagaggggagagtgacttggagatgtgtgattgaggacagtgagcacagtgagttgatggtgttgctgggttataagcagcttcaaagagaaggcattttgaatgaaggtggaaacataatggccaggagaacaagcaaaggactaggaaacagtgaacttcatcttggcctcaagttcctgaggtgcatatgaataaacagtctctaacccagagggtttcaagaaaagcagagtcctcaaaatccaaaggtagagtttccccacattgatattatactaattacacgtataacagtactttggaaaagcacaggtctctggtcacctctaaaaggcaaggttggtaaggaggtcagggtgtcacctgttggtagtcttaactaaatggtctcttcaagggatctaaggatggaaaggggatatataatggttggattaaaggctcatcattgattagcaaattgtcccttttgtttcttaaacccaatttgtacagggaaagttatgccactgtaagatatttttaaatggggaaaaaaaaaaaaaaaaaaaaaaaggttataccctttgaccatgtatgtcaaggttaaaatggcctggatcagattgctacaaattcctgatagcctttgtattccttcagaaacacaagcataatgcaaatctgtggctctacagctttgaaaccaaaactagtgattatcagagcttttcatgttatccagatggggattttaccccactcccccattgccattgtggaggcacaggtttgttaccagcaactacaagtttatgtagcattgggaaggtcagggattatcatagttccctccacgctttttcccccataatcatgggggcagatatttcagctgtcagctgttcatcttaaaaacattaggttaacagcagcaccaaggactaattcagaatatgaaattacagaaatgatttgctaatgatttagtagccttttatcagttaatgtttggtcaggttataaaagaccaaatgtgttcagtcacaaaatcctaagtgtattgagtattgcatgcttagtgatcaagttgtaggcatccttctagccatctggggcaggtaaaagttgggtgcttaacaaaagtggtttttacactgtttctgtcctaagagacactgttttttaatagcttaaaaattgacctaaagctgttatttctaatacaggaaatagattaccataatttgacatagctttaaaatatttagctcttactcgatagatttgctataaaatcaacttttactgaggtaagagaaactggcatttctgctttaaaaataatcacaaaagatagtttatcctggcgatatcatttcacactaggatagttacttttgactgaaaccagggttaaaaataagattgtttcccacttcaaaagaaaacatttaccaacatgaaaaaggaactatgtataactgttttagcatcatttcataatcttattttcatattgtgaagtaaccttcttgaantaaagcagaaaattaagactttcagaaaacaagctgtaccagttaaagctactagagacaggataaaggttaggaattctttggatagtttctcctagctcaagcttgtccaacccagagcccacaacagctttgaatgtggcccaacacacatttgtaagttttcttaaacattatgagctgttttgttttgagctcatcagctatccttagcgtattttgtgtcacccaagacaattcttccagtgtggcccagggaagccaaaagatgggacacccctgtcttagttgattaacacaggaggctgttaaccatcaacctcacatgcacaatattgggggtagtgcagggataacaagctcaaatgccagcaggggccaggcagacaggcagtgtatatgaacagactgggtggactggggcacactggaaaacacgctatgcttgtcgctcagcttattggagcgtgagtccagatttagcttcacctgtcctttttccagagaagctagatatgtggtttttaaactgtcaacttttacgtggtaactataaatttttttcttggaaaagtatttagggtgtgtcaattgccgcctgtgggtgaacaactgcaactctgtagcattcagaagccacctttgcattcctgactagctttggttttctgtagaaaaccaaaaagctgaggtttttttcctttaagaaatgttttctagataagcatttttagaaattcataggtggatattctcaaatacattaggcatagtcagcattttaaaagcctcccctccacaatacagtgcctacaggaaactcctttcaaaacagagatctagccacattgctttccttggcatacaaccaatggctcttcttccagcgatgagagctgctgtcttcacttttaagataatgcttctaatattttgccattaattaccttgtgatagggctttgatatcccaacctattattcatagtctactgaagagtttttttatcatgaagaaatgttgaattatatcaaattattttcaatcaaatgagatcatgttaacaggagtatgttattcctgttaggaattccatattaggaatatgttattcctaatatgttaacaggaatcattcccatcagtaaatgttatttaaagcaaaaaaactcaaaactcttctttccttcccttgccttttacagtaaaatgccatttcccattctcttctgaactcacctctaccaaaactgctcattaaggtcactagctgtctttcacttaagccaaaaagcctaggatctcctctgacaaattttctccccctcatcctcctcaccccattcttcaatcttttagcaaatccagctgcctgtacaatccatgccaccgaatgccgtaagtgagacgtaaaaggtaagccaaagccgcacttaaaattgccagtgactttcctcgtctttcttccctccatacgttcatgggctctccctccttttcacttaaatgtcaccttaccatagaagccttccacaacacctcagaagacggcctataccctgtatctctagggatctatctatctatctgtctgtctatctgttttatacttcttatagcacttattcctatctgacacactgaataaaactgataaaactaataaactgtttcaaacaaacagaggaacaactttgttttcctcactgctattattactatggtcctacttttggaaaaaagattcagtttgctaataaatacttacatataaggttttagaaaactgagatcagccttggtagattctgtaatccaggttatgtcagcttcctaaaaaagagtaacttcctgccttatatggttacttgtttctgagggaaagcttattacacattttctttatcttctatcttttgtatactaaaagtgggagacactgtttgtttaattttaggccactactcttctttctaaaatcgggaagcttacaggtaagagatttaaaggtaagcgataatgggctgtgtcaacatccgtattttactgacgtattttactgatgaggcagtcaggagctgaacctagctgaacccagctgcaaccttaccctataaaccagattttcattaatgaataattcaagtgacattattttaacataagtggacccgattctagaaggcctatgtgtttaagaaaaaaataaatggaaagaaacaacaatgcagtatttattttatacagctgacctgggcacattgtgaagtaagctataaaaattccaaataattatctctaaagcaaatcctttgttagttacatggctttacatattaattactctggaaagtttttgaactctgtttagtagcagatctcctttcttgatagtttcttggtactgccagttcttgctatcaggtctataaataaattcaagaaaaaatgaattatttaccagtcacattattccatgacaatagttgacctacttttaaaatttaggaatgccccttattctgagaaatgagagtacctgttggtttctactatttcattcactttatctattttgcagtgtagtctcccggcagcaataaacctggacagttccctaatttagagacaaaaaataacagaattagctttatagaaaattcttagaaaaatgcaaacggcattaaaatactgtcttaaatttgtaacaaacatttagcttcccttcaagcttgttattgcacatgcagtagttgacgttgtccctcctatactgcaggctttaagtcatcatctactagaataaacatgatcctagaagttcatattcagatagatagaaagtagatcaaacaatgaaaccatatgtactcagagaaaaactgtaggttaggaaaaattagggaccaaaactgataaaaacagtaaactgtttcaaacaaaagacctaaaacaaaattatggaacacagcccatcagtaaacatgtcaacagcaatagtattaacatgtcaacagcaatagtatttactaaaacaacgaccctttccctctctaacatatcttagtctaaacaagtggaagggaaggggagaaatgatgtagaattattgctttgcccattttaaaaaaggggatttcatctaaaatgtaactttttaagggagaaaaaaagaataaagaatccatgacaacccagatttgaaattcttaggtatcacagaaatttaaaacaaggcctttttaggtaacaacaactagagctcagtggtacaacctttgcctctcaagctggtcttagaacatgaagggaaaaaaaaaaaactgaacaaatactacctgaattcaactactacctgaaaggtaccagctgccttgcattcacttgtcatcaagatgacttaaggaatactgcggtgtgtgcccctaactaatgaaggctttatctccacattacagttacgatactgaagagacgtaacctgaccaaggccacagagctggaaaaagaagcaaagccaagccgtttttctcatgcactgctcacaacaagcccctccttccactgactcatgaaaaacacactcataatgcccagcccgcaccctaatgaacagccctcttaagagtggtcatcagacttcaatttcacagactagaattgagaaatggaacaaaaccttgggataccagccttccattttggtagggatcatttaaaaaatggtagggatcatttaaaaaatgtgttggtgtctgaaacttactttgaagtggttaaaaaacataaaatgtatagattgtaacaagcaaatatgttaaaatgtactgtacaattctttctttacaattttatggatgttcgaaatttaaaaaatactagaaagagaatggtcttatttaaaagaaatgcatcttcatttaaagtttccactgcagaccattgaaaacaccatcatcaacatttaaaaacacctacatgtgggagccactgatctagatgccatctggacatcccatattgagtatgtctcctacccaactctactctcaccaccctcgtccacgccacggtaacatctcctctaagagctactaaacagcacaactggtcctctctgccaccttactctatttcttatataaagacactgcataggaccatgtaacttgggctctaaatcttccaatggctccctatcaaacttacttaaaactcaagctccatcccatgacctacaaggccctacacaaatcattacctacctaactctccatatattatcctcaaaatctcctaccactccaactatgctggagccaccctgacattttctgttcctacaacatccaagcttattcctggctcaaagccttagccttttctattcccttttctgcacgcagaaggactccatatggctgactcctctcaattcaaatctcagagcaaacctcacctccttaagcatgccgtacgtaaggatagcattttctcatctccataggttcatttctatatgtgaaattacgttttatatttatttgcttccttgccatctcttccctactactacaatgaaagtgtgaaaagggagctgtaaaacaataccaaacatatagtaatgaatggctcattaagtatttatttgtttaatcactgatgcaagtactaaaagtcccacatttaacaaccaatctgaccagaattgcagcagcaacctaaaaactggaaggaattatcagagggaatatgaccaactgtaaatatcagatctaagagtcattaccgtagctgcagtgtggtctacaaagaagtaacagaagacaacttttgataacaactggtctaatgacctttaacaaatcacttagcctcactacaactcatcttcccatctgttaatgcaaggggcagacatgacatgaggaaggcagaggcaacaggatacgaatgttttgataatactgaggaaaaaaacctctcccctccccgttaagattgagggaaccaatgtaaacaagtaaaaaattgtacaagttcacatattttaaaaggcaactttaaaacttcaattaacatggcattattcaaacttactgatcaatgaattccacaccaacaccaaacgcttctgccatatagccaagggttaatgacctatatgattccagcagctgactgtatgcatgaattctcatttctcttacatagtatcgataatgaggggcaaaaagccagtcctttttcatttcctgttccacaaccgctgcaatgaataaaatgacaaattataatagactctccgtttcagataaaaagattaaaaactaaagcaacactactagttgagtccaacagatagatgaacaagtatcaaatttctcactgcccttccacatcatgtcatcaacaatggcagcaacagcagtgataaaggaggggccaggtatgcaaacatcgtcttcaagtaacaggtggctatttgacatcactatcagagctcagcttctaaaggaacttgttcatagatgacaaagttcacgtactaatattttaaccacggagaacttcttatgccttaagtaaaataaagtaaaaatcattttttaaacaattctaacagagaaacagcaggtacagtgaaaaacgatttatacagaccagaaaaaaggtataaatcagacattttcaaaaagcaacaaaactcagaagaaagcaaagactgatgactcctattgcctgtttatttgttcacgtaaatagtctacgtaagaaaacactatgaacaaggtttgaagacaaatgataaactagaaaatttataacgatgagttaatggccttaatccagaagagatccttagaagacagtaaaatgtacgtagagtattaatgagcaatccacacaaatataaattattttactgaataactcctgtatatcactactctagatagttatatggcagtgaaccagaagacaagacccttgctgccacaaaaactaaattttcaaagggcagagacagatgaacaaatatacaagataaatcctgtgaagaaaataaaagtaacatgatagagtgactaggaagccctccactggattggggtggacagggaatacctctctcaggggctggctaagcacagagcaatgtaaatgatacaaaagtctgaaggcaggaaaagcatggttaagcccaggaacagaaaggatgccagactcagaatgcaagcaggaagacagcaacaggtatatagaaggtgagcaagaaaagagactctagagtatacttatgtttgtggtttcaacaagatggaaatccctggagaaggagaatatttgtttttagtgttgggggtgagggtgggattcaagcatactttggcagtgttcaagtggatatgcctattaaacagccaagtgaggacactaaggaggcattgaggcatgagtctggtgctccagtttggggctggcgacatgaatttgtccatcactgccatccaaatgtatctgatggcacaaagtgaagataagaaacaagggcaataacccagtctaaggcagtcagacactgagaggtctaacagtggatgaggaggtaggtccagagaaaacaagagcacgttactgcagaaccaagagaaagctgtggtgagaagcaaaggatggtcaacatcaaggcagataaagataagcaagggaacacatgatttagcaacatggagatcaatggccactaaccatgagatggtgcgtattctcactaataagagaaatgcataaaacatcaataaaattatttctgtcctctcagactggcaaagagtatggagagggtgggacaggttctctcaaatgctatagattgagagaagtataaattgtgtaaatgtaaactgacatatctctggagggcaacagtggtcaagacacaatatatttaacctttggaaagttcaattttttagactttttcccccaaggaaataacaagtgggaaagataaattgttggagtgttcaaaacagggttgcttataatagggcaaaactggaaacgacctcgttttctatcagtagaggataaattatggcatagccaatacattgaaatactaggaagtccttaagaaaggataacctgaagctcctaggaacactacctgttcaatttgctgctattctcaatgttagtacacgatagccactcaaaaacacttactgactaaatgaccaactatatgtatagtgacatgaaaagatatacacgttacttgtgaagagaaaaaaaggtacttacaaaacagcatataaaatacatccacaatacacaaaagtgttacatgctcttatctctggataacagtgcccctgaaggacacactggaaaacctgattaacagcagttgcctctagagaaaggacactggtgatcagatattaaagaaagcctttttcttctttatatgatactgtttacaactgttccatgtgtacatataacttcggtttttaaatgttttttcttttttaaagtgcatataataaacgagtaaaaggccgggcgcggtggctcacgtctataatcctgcactttgagaggctgaggcgggcggatcgtgaggtcaggagatcaagacgatcctggctaacacagtgaaaccctgtctctactaaaaatacaaaaaattagccgggcatggtggcgggcgcctgtaatcccagctgctcaggaggctgaggcaggagaacggcatgaacccgggaggcggagcttgcaatgagccaaggtcatgtcactgcactccagcctgggcgacagagtgagactctgtctcaaataaataaataaataaataaataaaaggtctacaaggatataaaacaatattaaaatcaccgtctcaggaaaaattttatatgtgagtgaatgtgtgtatggatttgggggtgaggtgagatacaaaacctttcactttctcaatttatttttgatttctaaatatagtcaggtactacctagaaaaggatactacttccttttccaattgaattattttagagcacattagtaccaagtgctgtcctgctgtcagggtcatgaagattaaaaaaaaaaaagcataagttctgctcccagaaattctagttagcaaaggaggcaaactaggaaattatcacaaaacagagtgctaagttttagcaattggggcacatggccagttaagtatatgaaaagatgctcaatgaaactagtcattagaaacaaatcaaaattacaatgagatatcatttcacacccacaaagatacctataatcaaaaagacagaaaatagtaagtactggatgtgggaacactggaaccctcacacagctgatgggaatgtcaaatggtgcgggcgcctgctttagaaaactggcagttcctcaaaaagtttatcagagggttgccattaagatgcagccattccactccatatgtccacagaaaaagctgtacacaaatcttcattatagcattattgatagtagccaaaaagtgcaatcaacacaaaaatctatgaactaatgaatggataaataaaatgtagtatatacatacaacagactatcatttggctataaaacaaaatgaaatactgatacatgctacaacatggatgaatgtgggaacattataaagtgaaagaagccaggcacaaaaagccacgtattttatgactgcatttagatgatatgtccagaataggcaaattcgtacagacataaagtagatcagtggttgccaggggctgggggaaaggagtaatagggagtgactgctaatgggtgtcggtttccttttggggtgatcaagatgttctggaattattaatatttgcaaaaccttgccaatatatgaaaaagcactgaattgtacacttgaggtaattttatggtgtgtgatttatacctcagtttttttaaaggagggggcatacaataaccccaggaatgcagagaagtaagagatttgttctgactgagggaagcaaggaagggctccctcaatttttttgaaggagggagcatacaataagaatcccaggaatgcagagaagtaagatttgttctgactgagggaagcagggaagggctccatatttgagttgagtgatgaccaggagacctcaagcataaaaaagggaaaagagcaattctacaatataaccttatatgcaaaagcaacataactgtgtgtgtatgtatgagaagataaggccaagtgagttactcatcatgctcgggaaacctgttcctacattacctgaggtaaatactatgaattctcataaagcagcccaatttatatgcatggagaaagcatccaaaaacactgggccaaaacccactgcaaaaacattaacaatcgtcatttggaaccgtccattcccacttttctccaaagctatctatttaaccaaacaccttctgaaatttgcagcataaacaaaatatatcaatgtcaaattttaagttttgggaaagacccctgggtcaacttgatgcaagctgattcttctatcatcttaatagtttgtggtcattattaggaaaccaaatagccaggaaagaatggggacaagagggagaaacaagcaaatgtgtgaaggcaggatcactacaaactagctttgaaggaatacaattacgttcaagagattattttcttaacccatagcccttgaaaatgatttgcaaatcagcacagagatttagctatttagctattgatacagaatagcccattgctgaattcaaggttcaattaatctccaccccaaatcacattcagaattccctcacttctgtccccatgaagctcaatacttaataaccatttgctcacttttgccttataccccattaagactcttaaccaggggtctggcaaataccctcagcaaagggccagagggtaagtatttttaggctttgcaagctacatagctctccgtcacatcctccttttttaaacaacactttaaaaatgtaaaaatcattcttacctcctgggccatacagcaggccacaatctgatgacccttcttctaaacaaaactgggcacattaggaatactgatcaaagacatgcagctacctacacactacatttctcagataggtgaaaaatcgtcttaggttatttgcacataggatcaggagtaagatgaagacagataatcaaaaatatcaaccctatccttacctaatgattggaagaaaacagagtaacggcattcatagagtgaaaacagatactgccgaactgctggaagactgtgcacacttcaagaatctctgctcctttaatgacctaggtattttaaaaaacatatatacaaaaaaaatgtacattttaatgatttgtgtatttaaacaaaaaaaacaagtctttaaatttgagtattaaagtttggtcattaccttttccctgagatctggtctttctaaggcaatcatactgacatagacagtataagtcacaaatgttttataatccatgagttcataggatgtaaatgttgaaacagtgtcaaggaagagttcagctgcctgtttgaaatcacgaatagccacacaataaagaccctgatacacttttaggcggtttctcctgtcccagtctcctccttcttctattaagctatgaaataaaaacagtaagatcatagtctggaaacagacaaggccacgttttaaaaacttgtctgttatttgaaatgagaaaacaacttttaacaacttgaaccgaaaggagatatttaaattattttactaaataagtacatcaattatttgaccaaacttactagctgtaaacaaaacaggcagtttcttatatcagcttctcatttgtagcatcataatttagagaaaatataatcccacccttagaaagtaccttttggccttttctgtgtttcgtgtgatgagatcattatccatataaaataagccaatcctaaggagatagaatacaatatccaatcggtgacccagggccacagttttgtcatatgtcttgcgaaaggctgtcagagctccctcctgtcaagaaagccaaggcaataggtgagaaaaggctacaagtttccaaaaaaagctatcagctgtctgggattttcttcaaaggttgagggaagaggtaggagtagaagtacaacaagatggccattaactgttaattgttgaagctgggtgataagtacacaagggtttattattctactttctctacctgtataaagtttaaaaaatacataagaaatgcccaagcatatacttagattcaggaaaacaatttaagaaaaatatattcacaattgttaagtatttttctctgttctatatattcaatgttttctctcataatcacaatacactacatcaaaataacatcatctgaagggttttggaaattgtatcttagtcgctattagaatatgactaaatttgtaaatatataattttctctcaaagcactgtggaatgtttcctttgctttgaatatgaataaaataatttgttcacacttggtagttttcagtatgtgtctgcctggtttatgtaattattagttatatttcacaaatttataagggactgggaatacagcaatggatacacctagcactaagatcttggtttttaaatactatcccccactaaaaggaaccagggatcctaggagaaatagataattctacgtttattagagtgaaaataacaggtgaacctgtgacattttgttttatcagaaaataagactaatgagatatgtcaaaaggacaaagtgtcttgacggagcctctgctaacaaatttgcaacaaacttagcaccataaagaataagactctcatcagtggtaacagtgaataataaaagcccactaagtccattaagtatttagtaatactaaataaaataaaatataaaaaacgagagtaaataggaggggaaaagttgttcgttttggaagagtatttaataaatacagaggaaatataatattagaacattttacaacttcctgatactgattcaagcatgtccttgttgaaattcttcaaaacctgaatcaaaagtttcaagtttctcattcatatgtaatatattagtctttaaaaccaagccacaaacatacagcttaaaagtaaatggaaaccactagataattctaaacttttctgtattttccaaatttttacaatgaccacgtcttaagtttacaaccagaaaagagaaaaaaacctcgttttagatatacattgcaaaacaacatttaggcacttactatgtgctaggtaccagtctaagctttttcctatccttaatccacattaagtaaaaactatcagtactcctgttttacacatgaggaaaccgagggtttcataaatcataattaccgaggttgaaaacagaacccagacaatctgattcaagagctcatgttatttttattttttatattggcaccatgtcattctatacctaaatacttccaggcaaataatttaaaattaaaaacattcaaagcccattttcttaaccactattacacagttactcaattaaatttcaaagatccagtaatggtgagtacccctctggtgccctgatggtggagtaagctggctgctatgcagaacaactggccacacatatttaaaaaaaagaagaaaaaaaaaaactgttcattgtcccggcgattttgtttcatatactataccctagagaaacactagcatatacacacagagacatacataagcatatttttacagcagcagtttgctaaagcaaaaacagatgaaaacaacacatatgtccaacaacagctgaacaggcaaataaactatgccagagctagctctacagtggaacattaggcagcagttaaccaggatgagccagatttatgtatgttggcatggaaaagacctcttaaatataatgctgaatgaaaagggcaaacaggactacactaatacactatgatcctatgtacttaaaaaaaaaattctgtagaattaaaaatttctgcaagtattaacttttttaaaaattggttctttcattgagcatttatattcttttacatataaaattttacgtaaaaaagattttatgaccgggtgcactggctcacgcctataatcccagcactttcggaggccgagacaggtggatcacctgaggtcaggagttcgagactagcctggccaacatgttgaaatccagtctctactaataatacaaaaaaattagctgggtgtggtggcgcacgcctgtaatctcaactactcgggaggctgagggaggagaatcgattgaacccagcaggtggaggttgcagtgagccaagatcactccattgtactccagcctgggtggcaagagtgaaactccgtctcaaaaaaaaaaaaaaaattaccaaaaagtttgcataaatgcacaataaaagaactgaaaagcctatccctgggcaggtacagagtaaagaaagataacagaacttcagcatttactatactgtttcttagtttctgctaagtattactcgtgtaaagtactaaagacaccagaaccagtgcttcccaaccaagtgagaaaactgctgaaaatgatcccaattttgtaaaagcagtaaataaaattctctagatgtacacttacgtttttatcggcatggggtgaaatggggaagaatacagccctagctgctgtttggggaaatgacaaggcatttcatggagacgactttttcatctttacattgattcaccagtacaagcaagcatgattacctttatactttttctaaaacgaagttaatttttttaatgagaaacgattacctggaatagtctccaattttagcctatactaactacagagagggaaaaccatctctactcactttgtcacctatccggcagaggtactcggcctttgccatcattgcatcgcgaatttcgctctctcctagattcttctctgcatcttccagctcctcatccaaacgcttcaactcatcttcatttgccttcttcattttattgagtaggtccacgtctatctgccagtcgagggatttgcacaaggcttcatagtaaggagccatgtctaacatgcaaaaagagggatgtgtgagtggggacacttgtgccctcaagtcaaagtctgcccacgtatttcaccccccgccccgccacaagtcatccaccagtctcttccccactaacaggaaggcatgcgatggcgcttaataatcggcttggcaaaacataaacgtatgctggtgggaggtttgcgtgacggccaatcctggcaatgccaacctctactagggctggagggagggcaatcctcggtttgctcttgccggattctgttccaaaagtcttcaaacagggaaagactttttatacacacatactcacatacatatgttcaaacatacacattcactacagaagggccagaaagaaccgaacccaaatttcccttccacaggcaagctgaactctcccacaggaataccccgcgcccgggagcagtccccactgacagaaagtcacggggcctttactctgtgcctagcacaggggtaaatattaatgcctcacgattctcccccaagctgcccttacaggggaaggcggcacagagagatgcagaccccgctgaggcaagtcgaggtcccccagggtatccccaaaccaaagcaaaaccctaagggccggagaagccaggcctggtctctgagaccccgtcagaggggtctggagctccatcaaaaaaagtccccgcaggctccggaacgcggggacggcccaggcctaggccgctgactcggcgctcgtgcgggcctcactgttatcgcggacggccgccatcagctcgtcgcgcacggcagcgtctccgcggtgctcgggcaggctgagcaggaagcgcagctgcgcgatacgcaagtcggggttcttgggcagaccctcctcctccaggttctccagcggcatcgcggcgaaggggacagcggctgacaggacacaacttggttacgaccggctgcggcagcggaagcgggaggagtcggcgaata

SEQ ID NO: 13294 - DNA, 122 bp, Homo sapiens
caccaccatgcccggctaatttttgtatttttagtagagatggggtttcaccatgttggccaggctggtctcaaactcctgacctcaagtgatccaccagcctcagcctcccaaagtgctgg

SEQ ID NO: 13295 - DNA, 19481 bp, Homo sapiens
tgtttgcaaataaaccattctgataaattatttttgttgcttaaaataagaggaggaaccgctgtgtgttagcaagaatgtccatacctgatatgaaagagtcatgttggcttcagttcctactgccctgtggacttcccattccctccttacttgagtcaaccatccactcagtactttccacaaatctaataatgaggtgctctctgtaggtaaatcctttcactatggcttgtcctcaaacctcccaagaaaaggttcaactgctcaatctcttaacctttttaattccattcccttgcaggtatcccggccctgcataacaagatgatcccaactcaaggaaaggggtttagcagtgttggatcttggcgtatgtgggatttaaccaggcagaaaggcagacaagagtaagattctaggcagagagagcaaatgcgtcgagcatgggtatgaacatgtgagggatagagaataattctgcaggaagtttgctggatggaagggccttatagggttagaaaagctggtgtcagattgtcaaggactttgaatgtcatggggcttctcttccaggaacacatgggatcaggcttagattaacccaaatgtaattgtcagagcccagagatatttcatggtccagtcctagcactgtgcagctgccaaaagtcaaagccattcaaatctgtactgaaaactgtggaaaagcaaaggagcacttaagtctctttccccatgtcttgcattctcactctcttttgcttcaaagatctgtctttacctgcccctgtccccagtcctaacaaaaagcactcccctaaatcaactcttaagttcctctcccttctcactcctttcttagtctcctctttctgtaagaagttcttgctcctgttgttaatggaagttaattaaagtagtatttcaccttgtaaggctgtaattcttggcacttgttatcctcattttctacatccaaagaccatggaccagaatatctcttaggaggtaagggagagtgaggctatcagccaaagaaaaagtctccagggggaaggggagaatcacttataatttaatactttgtggaaaaaacatctctgccacctatggccctccaataacaatggaagacagaatcaacaggtgagaaccttgggacaaaaataagttacaaagctgttgtaatccaggtaagagctattaagtttccaaacgaaggctgactgtgaggataagtgatactgatttcagaaatctttaaaaagtagaaccaacaagccttgaggtctaactctgttcaacattaaagggaagagtgagtctaagaagacttcaggtttctagcttggccaaaccaattgagctttaagtgaaatgtgcgatatggtaacagagaaggaaaaagacataacgatagatttgagctgctggtgggaaattctggtttagtgcccagctggctgtacaggctggttggactttaggagggaggtttgagctggaaaataaagatggagagttgtctttcagttttagatcatcagtgaggtcataagggtagatggagtttacctgggaaaattaagtagctattcgatttggcttattattatgttaaaataatacttctctagtgaagtacttaatatgccagatactgtgccaagcattttatatacatcctctcttttactaagccctcatagggcaggtattttgattccaatcatactgattggaactcctaagaaggtatcttgcttaaggtcccacaacgaataggtggcagatccagggtaattcaggtctgtcagaacagtgattcttaattttttccctcctcagactccaggagtcacatgaagttatgcatcctgtctgaccgaggcacaggcacaccacatttttatattccgcttccaggatatcacaaacctgaagcccatcctccatggcccagagagaaaacccaggacaaaaccttggagaagactattttcatgaagacaaatggagaaggagcagtagagtaaaaagagaggtaagggaaggcattgagatggtttacagggttagatgttttgagtcaatcccattataattaccaatgctatctacctatttagttaacgttttattgccctgctgttttctccaggataattggaacagcatgtattggttgggtggaaaagatagaacttgagcagggagattgccaaagagtgaagatgtggctgagtgattgatgatggtctgaactgggtattcagggaagagaactagaagccaaccatgtagaatctatgcaggtgctcttaagacattggtttgactggaattatcttcttgttaggtcttaggaatctccttccaggtaactttttctatgattagacaattgatttgttcagggtcacagagcaaagtccacatttaattccacatggccaataaaagtgaggggctacaaggtgagatccaggggccagagttatcaaagtgatacagcacttttaggaataggacagggaatggaggaattggaattccagtattactttcaaaagcagaactggccagaggaattggaattccagtattattttcaaaagcagaactggccagaggtgcttgtgattcctgggtggaaaccatggcagtggacagaagcagcatggaggaaaagagcactggaattcaggctgaggaactgtgaagccaagggtgttgtataggttgtccatttcaaattagggttgcttggttctgggatgatttgcatggaagaggggagagtgacttggagatgtgtgattgaggacagtgagcacagtgagttgatggtgttgctgggttataagcagcttcaaagagaaggcattttgaatgaaggtggaaacataatggccaggagaacaagcaaaggactaggaaacagtgaacttcatcttggcctcaagttcctgaggtgcatatgaataaacagtctctaacccagagggtttcaagaaaagcagagtcctcaaaatccaaaggtagagtttccccacattgatattatactaattacacgtataacagtactttggaaaagcacaggtctctggtcacctctaaaaggcaaggttggtaaggaggtcagggtgtcacctgttggtagtcttaactaaatggtctcttcaagggatctaaggatggaaaggggatatataatggttggattaaaggctcatcattgattagcaaattgtcccttttgtttcttaaacccaatttgtacagggaaagttatgccactgtaagatatttttaaatgggggaaaaaaaaaaaaaaaaaaaaaggttataccctttgaccatgtatgtcaaggttaaaatggcctggatcagattgctacaaattcctgatagcctttgtattccttcagaaacacaagcataatgcaaatctgtggctctacagctttgaaaccaaaactagtgattatcagagcttttcatgttatccagatggggattttaccccactcccccattgccattgtggaggcacaggtttgttaccagcaactacaagtttatgtagcattgggaaggtcagggattatcatagttccctccacgctttttcccccataatcatgggggcagatatttcagctgtcagctgttcatcttaaaaacattaggttaacagcagcaccaaggactaattcagaatatgaaattacagaaatgatttgctaatgatttagtagccttttatcagttaatgtttggtcaggttataaaagaccaaatgtgttcagtcacaaaatcctaagtgtattgagtattgcatgcttagtgatcaagttgtaggcatccttctagccatctggggcaggtaaaagttgggtgcttaacaaaagtggtttttacactgtttctgtcctaagagacactgttttttaatagcttaaaaattgacctaaagctgttatttctaatacaggaaatagattaccataatttgacatagctttaaaatatttagctcttactcgatagatttgctataaaatcaacttttactgaggtaagagaaactggcatttctgctttaaaaataatcacaaaagatagtttatcctggcgatatcatttcacactaggatagttacttttgactgaaaccagggttaaaaataagattgtttcccacttcaaaagaaaacatttaccaacatgaaaaaggaactatgtataactgttttagcatcatttcataatcttattttcatattgtgaagtaaccttcttgaataaaagcagaaaattaagactttcagaaaacaagctgtaccagttaaagctactagagacaggataaaggttaggaattctttggatagtttctcctagctcaagcttgtccaacccagagcccacaacagctttgaatgtggcccaacacacatttgtaagttttcttaaaacattatgagctgttttgttttgagctcatcagctatccttagcgtattttgtgtcacccaagacaattcttccagtgtggcccagggaagccaaaagatgggacacccctgtcttagttgattaacacaggaggctgttaaccatcaacctcacatgcacaatattgggggtagtgcagggataacaagctcaaatgccagcaggggccaggcagacaggcagtgtatatgaacagactgggtggactggggcacactggaaaacacgctatgcttgtcgctcagcttattggagcgtgagtccagatttagcttcacctgtcctttttccagagaagctagatatgtggtttttaaactgtcaacttttacgtggtaactataaatttttttcttggaaaagtatttagggtgtgtcaattgccgcctgtgggtgaacaactgcaactctgtagcattcagaagccacctttgcattcctgactagctttggttttctgtagaaaaccaaaaagctgaggtttttttcctttaagaaatgttttctagataagcatttttagaaattcataggtggatattctcaaatacattaggcatagtcagcattttaaaagcctcccctccacaatacagtgcctacaggaaactcctttcaaaacagagatctagccacattgctttccttggcatacaaccaatggctcttcttccagcgatgagagctgctgtcttcacttttaagataatgcttctaatattttgccattaattaccttgtgatagggctttgatatcccaacctattattcatagtctactgaagagtttttttatcatgaagaaatgttgaattatatcaaattattttcaatcaaatgagatcatgttaacaggagtatgttattcctgttaggaattccatattaggaatatgttattcctaatatgttaacaggaatcattcccatcagtaaatgttatttaaagcaaaaaaactcaaaactcttctttccttcccttgccttttacagtaaaatgccatttcccattctcttctgaactcacctctaccaaaactgctcattaaggtcactagctgtctttcacttaagccaaaaagcctaggatctcctctgacaaattttctccccctcatcctcctcaccccattcttcaatcttttagcaaatccagctgcctgtacaatccatgccaccgaatgccgtaagtgagacgtaaaaggtaagccaaatccgcacttaaaattgccagtgactttcctcgtctttcttccctccatacgttcatgggctctccctccttttcacttaaatgtcaccttaccatagaagccttccacaacacctcagaagacggcctataccctgtatctctatctatctatctatctatctgtctgtctatctggttttatacttcttatagcacttattcctatctgacacactgaataaaactgataaaactaataaactgtttcaaacaaacagaggaacaactttgttttcctcactgctattattactatggtcctacttttggaaaaaagattcagtttgctaataaatacttacatataaggttttagaaaactgagatcagccttggtagattctgtaatccaggttatgtcagcttcctaaaaaagagtaacttcctgccttatatggttacttgtttctgagggaaagcttattacacattttctttatcttctatcttttgtatactaaaagtgggagacactgtttgtttaattttaggccactactcttctttctaaaatcgggaagcttacaggtaagagatttaaaggtaagcgataatgggctgtgtcaacatccgtattttactgacgtattttactgatgaggcagtcaggagctgaacctagctgaacccagctgcaaccttaccctataaaccagattttcattaatgaataattcaagtgacattattttaacataagtggacccgattctagaaggcctatgtgtttaagaaaaaaataaatggaaagaaacaacaatgcagtatttattttatacagctgacctgggcacattgtgaagtaagctataaaaattccaaataattatctctaaagcaaatcctttgttagttacatggctttacatattaattactctggaaagtttttgaactctgtttagtagcagatctcctttcttgatagtttcttggtactgccagttcttgctatcaggtctataaataaattcaagaaaaaatgaattatttaccagtcacattattccatgacaatagttgacctacttttaaaatttaggaatgccccttattctgagaaatgagagtacctgttggtttctactatttcattcactttatctattttgcagtgtagtctcccggcagcaataaacctggacagttccctaatttagagacaaaaaataacagaattagctttatagaaaattcttagaaaaatgcaaacggcattaaaatactgtcttaaatttgtaacaaacatttagcttcccttcaagcttgttattgcacatgcagtagttgacgttgtccctcctatactgcaggctttaagtcatcatctactagaataaacatgatcctagaagttcatattcagatagatagaaagtagatcaaacaatgaaaccatatgtactcagagaaaaactgtaggttaggaaaaattagggaccaaaactgataaaaacagtaaactgtttcaaacaaaagacctaaaacaaaattatggaacacagcccatcagtaaacatgtcaacagcaatagtattaacatgtcaacagcaatagtatttactaaaacaacgaccctttccctctctaacatatcttagtctaaacaagtggaagggaaggggagaaatgatgtagaattattgctttgcccattttaaaaaaggggatttcatctaaaatgtaactttttaagggagaaaaaaagaataaagaatccatgacaacccagatttgaaattcttaggtatcacagaaatttaaaacaaggcctttttaggtaacaacaactagagctcagtggtacaacctttgcctctcaagctggtcttagaacatgaagggaaaaaaaaaaaactgaacaaatactacctgaattcaactactacctgaaaggtaccagctgccttgcattcacttgtcatcaagatgacttaaggaatactgcggtgtgtgcccctaactaatgaaggctttatctccacattacagttacgatactgaagagacgtaacctgaccaaggccacagagctggaaaaagaagcaaagccaagccgtttttctcatgcactgctcacaacaagcccctccttccactgactcatgaaaaacacactcataatgcccagcccgcaccctaatgaacagccctcttaagagtggtcatcagacttcaatttcacagactagaattgagaaatggaacaaaaccttgggataccagccttccattttggtagggatcatttaaaaaatggtagggatcatttaaaaaatgtgttggtgtctgaaacttactttgaagtggttaaaaaacataaaatgtatagattgtaacaagcaaatatgttaaaatgtactgtacaattctttctttacaattttatggatgttcgaaatttaaaaaatactagaaagagaatggtcttatttaaaagaaatgcatcttcatttaaagtttccactgcagaccattgaaaacaccatcatcaacatttaaaaacacctacatgtgggagccactgatctagatgccatctggacatcccatattgagtatgtctcctacccaactctactctcaccaccctcgtccacgccacggtaacatctcctctaagagctactaaacagcacaactggtcctctctgccaccttactctatttcttatataaagacactgcataggaccatgtaacttgggctctaaatcttccaatggctccctatcaaacttacttaaaactcaagctccatcccatgacctacaaggccctacacaaatcattacctacctaactctccatatattatcctcaaaatctcctaccactccaactatgctggagccaccctgacattttctgttcctacaacatccaagcttattcctggctcaaagccttagccttttctattcccttttctgcacgcagaaggactccatatggctgactcctctcaattcaaatctcagagcaaacctcacctccttaagcatgccgtacgtaaggatagcattttctcatctccataggttcatttctatatgtgaaattacgttttatatttatttgcttccttgccatctcttccctactactacaatgaaagtgtgaaaagggagctgtaaaacaataccaaacatatagtaatgaatggctcattaagtatttatttgtttaatcactgatgcaagtactaaaagtcccacatttaacaaccaatctgaccagaattgcagcagcaacctaaaaactggaaggaattatcagagggaatatgaccaactgtaaatatcagatctaagagtcattaccgtagctgcagtgtggtctacaaagaagtaacagaagacaacttttgataacaactggtctaatgacctttaacaaatcacttagcctcactacaactcatcttcccatctgttaatgcaaggggcagacatgacatgaggaaggcagaggcaacaggatacgaatgttttgataatactgaggaaaaaaacctctcccctccccgttaagattgagggaaccaatgtaaacaagtaaaaaattgtacaagttcacatattttaaaaggcaactttaaaacttcaattaacatggcattattcaaacttactgatcaatgaattccacaccaacaccaaacgcttctgccatatagccaagggttaatgacctatatgattccagcagctgactgtatgcatgaattctcatttctcttacatagtatcgataatgaggggcaaaaagccagtcctttttcatttcctgttccacaaccgctgcaatgaataaaatgacaaattataatagactctccgtttcagataaaaagattaaaaactaaagcaacactactagttgagtccaacagatagatgaacaagtatcaaatttctcactgcccttccacatcatgtcatcaacaatggcagcaacagcagtgataaaggaggggccaggtatgcaaacatcgtcttcaagtaacaggtggctatttgacatcactatcagagctcagcttctaaaggaacttgttcatagatgacaaagttcacgtactaatattttaaccacggagaacttcttatgccttaagtaaaataaagtaaaaatcattttttaaacaattctaacagagaaacagcaggtacagtgaaaaacgatttatacagaccagaaaaaaggtataaatcagacattttcaaaaagcaacaaaactcagaagaaagcaaagactgatgactcctattgcctgtttatttgttcacgtaaatagtctacgtaagaaaacactatgaacaaggtttgaagacaaatgataaactagaaaatttataacgatgagttaatggccttaatccagaagagatccttagaagacagtaaaatgtacgtagagtattaatgagcaatccacacaaatataaattattttactgaataactcctgtatatcactactctagatagttatatggcagtgaaccagaagacaagacccttgctgccacaaaaactaaattttcaaagggcagagacagatgaacaaatatacaagataaatcctgtgaagaaaataaaagtaacatgatagagtgactaggaagccctccactggattggggtggacagggaatacctctctcaggggctggctaagcacagagcaatgtaaatgatacaaaagtctgaaggcaggaaaagcatggttaagcccaggaacagaaaggatgccagactcagaatgcaagcaggaagacagcaacaggtatatagaaggtgagcaagaaaagagactctagagtatacttatgtttgtggtttcaacaagatggaaatccctggagaaggagaatatttgtttttagtgttgggggtgagggtgggattcaagcatactttggcagtgttcaagtggatatgcctattaaacagccaagtgaggacactaaggaggcattgaggcatgagtctggtgctccagtttggggctggcgacatgaatttgtccatcactgccatccaaatgtatctgatggcacaaagtgaagataagaaacaagggcaataacccagtctaaggcagtcagacactgagaggtctaacagtggatgaggaggtaggtccagagaaaacaagagcacgttactgcagaaccaagagaaagctgtggtgagaagcaaaggatggtcaacatcaaggcagataaagataagcaagggaacacatgatttagcaacatggagatcaatggccactaaccatgagatggtgcgtattctcactaataagagaaatgcataaaacatcaataaaattatttctgtcctctcagactggcaaagagtatggagagggtgggacaggttctctcaaatgctatagattgagagaagtataaattgtgtaaatgtaaactgacatatctctggagggcaacagtggtcaagacacaatatatttaacctttggaaagttcaattttttagactttttccccaaggaaataacaagtgggaaagataaattgttggagtgttcaaaacagggttgcttataatagggcaaaactggaaacgacctcgttttctatcagtagaggataaattatggcatagccaatacattgaaatactaggaagtccttaagaaaggataacctgaagctcctaggaacactacctgttcaatttgctgctattctcaatgttagtacacgatagccactcaaaaacacttactgactaaatgaccaactatatgtatagtgacatgaaaagatatacacgttacttgtgaagagaaaaaaaggtacttacaaaacagcatataaaatacatccacaatacacaaaagtgttacatgctcttatctctggataacagtgcccctgaaggacacactggaaaacctgattaacagcagttgcctctagagaaaggacactggtgatcagatattaaagaaagcctttttcttctttatatgatactgtttacaactgttccatgtgtacatataacttcggtttttaaatgttttttcttttttaaagtgcatataataaacgagtaaaaggccgggcgcggtggctcacgtctataatcctgcactttgagaggctgaggcgggcggatcgtgaggtcaggagatcaagacgatcctggctaacacagtgaaaccctgtctctactaaaaatacaaaaaattagccgggcatggtggcgggcgcctgtaatcccagctgctcaggaggctgaggcaggagaacggcatgaacccgggaggcggagcttgcaatgagccaaggtcatgtcactgcactccagcctgggcgacagagtgagactctgtctcaaataaataaataaataaataaataaaaggtctacaaggatataaaacaatattaaaatcaccgtctcaggaaaaattttatatgtgagtgaatgtgtgtatggatttgggggtgaggtgagatacaaaacctttcactttctcaatttatttttgatttctaaatatagtcaggtactacctagaaaaggatactacttccttttccaattgaattattttagagcacattagtaccaagtgctgtcctgctgtcagggtcatgaagattaaaaaaaaaaaagcataagttctgctcccagaaattctagttagcaaaggaggcaaactaggaaattatcacaaaacagagtgctaagttttagcaattggggcacatggccagttaagtatatgaaaagatgctcaatgaaactagtcattagaaacaaatcaaaattacaatgagatatcatttcacacccacaaagatacctataatcaaaaagacagaaaatagtaagtactggatgtgggaacactggaaccctcacacagctgatgggaatgtcaaatggtgcgggcgcctgctttagaaaactggcagttcctcaaaaagtttatcagagggttgccattaagatgcagccattccactccatatgtccacagaaaaagctgtacacaaatcttcattatagcattattgatagtagccaaaaagtgcaatcaacacaaaaatctatgaactaatgaatggataaataaaatgtagtatatacatacaacagactatcatttggctataaaacaaaatgaaatactgatacatgctacaacatggatgaatgtgggaacattataaagtgaaagaagccaggcacaaaaagccacgtattttatgactgcatttagatgatatgtccagaataggcaaattcgtacagacataaagtagatcagtggttgccaggggctgggggaaaggagtaatagggagtgactgctaatgggtgtcggtttccttttggggtgatcaagatgttctggaattattaatatttgcaaaaccttgccaatatatgaaaaagcactgaattgtacacttgaggtaattttatggtgtgtgatttatacctcagtttttttaaaggagggggcatacaataaccccaggaatgcagagaagtaagagatttgttctgactgagggaagcaaggaagggctccctcaatttttttgaaggagggagcatacaataagaatcccaggaatgcagagaagtaagatttgttctgactgagggaagcagggaagggctccatatttgagttgagtgatgaccaggagacctcaagcataaaaaagggaaaagagcaattctacaatataaccttatatgcaaaagcaacataactgtgtgtgtatgtatgagaagataaggccaagtgagttactcatcatgctcgggaaacctgttcctacattacctgaggtaaatactatgaattctcataaagcagcccaatttatatgcatggagaaagcatccaaaaacactgggccaaaacccactgcaaaaacattaacaatcgtcatttggaaccgtccattcccacttttctccaaagctatctatttaaccaaacaccttctgaaatttgcagcataaacaaaatatatcaatgtcaaattttaagttttgggaaagacccctgggtcaacttgatgcaagctgattcttctatcatcttaatagtttgtggtcattattaggaaaccaaatagccaggaaagaatggggacaagagggagaaacaagcaaatgtgtgaaggcaggatcactacaaactagctttgaaggaatacaattacgttcaagagattattttcttaacccatagcccttgaaaatgatttgcaaatcagcacagagatttagctatttagctattgatacagaatagcccattgctgaattcaaggttcaattaatctccaccccaaatcacattcagaattccctcacttctgtccccatgaagctcaatacttaataaccatttgctcacttttgccttataccccattaagactcttaaccaggggtctggcaaataccctcagcaaagggccagagggtaagtatttttaggctttgcaagctacatagctctccgtcacatcctccttttttaaacaacactttaaaaatgtaaaaatcattcttacctcctgggccatacagcaggccacaatctgatgacccttcttctaaacaaaactgggcacattaggaatactgatcaaagacatgcagctacctacacactacatttctcagataggtgaaaaatcgtcttaggttatttgcacataggatcaggagtaagatgaagacagataatcaaaaatatcaaccctatccttacctaatgattggaagaaaacagagtaacggcattcatagagtgaaaacagatactgccgaactgctggaagactgtgcaacacttcaagaatctctgctcctttaatgacctaggtattttaaaaaacatatatacaaaaaaaatgtacattttaatgatttgtgtatttaaacaaaaaaaacaagtctttaaatttgagtattaaagtttggtcattaccttttccctgagatctggtctttctaaggcaatcatactgacatagacagtataagtcacaaatgttttataatccatgagttcataggatgtaaatgttgaaacagtgtcaaggaagagttcagctgcctgtttgaaatcacgaatagccacacaataaagaccctgatacacttttaggcggtttctcctgtcccagtctcctccttcttctattaagctatgaaataaaaacagtaagatcatagtctggaaacagacaaggccacgttttaaaaacttgtctgttatttgaaatgagaaaacaacttttaacaacttgaaccgaaaggagatatttaaattattttactaaataagtacatcaattatttgaccaaacttactagctgtaaacaaaacaggcagtttcttatatcagcttctcatttgtagcatcataatttagagaaaatataatcccacccttagaaagtaccttttggccttttctgtgtttcgtgtgatgagatcattatccatataaaataagccaatcctaaggagatagaatacaatatccaatcggtgacccagggccacagttttgtcatatgtcttgcgaaaggctgtcagagctccctcctgtcaagaaagccaaggcaataggtgagaaaaggctacaagtttccaaaaaaagctatcagctgtctgggattttcttcaaaggttgagggaagaggtaggagtagaagtacaacaagatggccattaactgttaattgttgaagctgggtgataagtacacaagggtttattattctactttctctacctgtataaagtttaaaaaatacataagaaatgcccaagcatatacttagattcaggaaaacaatttaagaaaaatatattcacaattgttaagtatttttctctgttctatatattcaatgttttctctcataatcacaatacactacatcaaaataacatcatctgaagggttttggaaattgtatcttagtcgctattagaatatgactaaatttgtaaatatataattttctctcaaagcactgtggaatgtttcctttgctttgaatatgaataaaataatttgttcacacttggtagttttcagtatgtgtctgcctggtttatgtaattattagttatatttcacaaatttataagggactgggaatacagcaatggatacacctagcactaagatcttggtttttaaatactatcccccactaaaaggaaccagggatcctaggagaaatagataattctacgtttattagagtgaaaataacaggtgaacctgtgacattttgttttatcagaaaataagactaatgagatatgtcaaaaggacaaagtgtcttgacggagcctctgctaacaaatttgcaacaaacttagcaccataaagaataagactctcatcagtggtaacagtgaataataaaagcccactaagtccattaagtatttagtaatactaaataaaataaaatataaaaaacgagagtaaataggaggggaaaagttgttcgttttggaagagtatttaataaatacagaggaaatataatattagaacattttacaacttcctgatactgattcaagcatgtccttgttgaaattcttcaaaacctgaatcaaaagtttcaagtttctcattcatatgtaatatattagtctttaaaaccaagccacaaacatacagcttaaaagtaaatggaaaccactagataattctaaacttttctgtattttccaaatttttacaatgaccacgtcttaagtttacaaccagaaaagagaaaaaaacctcgttttagatatacattgcaaaacaacatttaggcacttactatgtgctaggtaccagtctaagctttttcctatccttaatccacattaagtaaaaactatcagtactcctgttttacacatgaggaaaccgagggtttcataaatcataattaccgaggttgaaaacagaacccagacaatctgattcaagagctcatgttatttttattttttatattggcaccatgtcattctatacctaaatacttccaggcaaataatttaaaattaaaaacattcaaagcccattttcttaaccactattacacagttactcaattaaatttcaaagatccagtaatggtgagtacccctctggtgccctgatggtggagtaagctggctgctatgcagaacaactggccacacatatttaaaaaaaagaagaaaaaaaaaaactgttcattgtcccggcgattttgtttcatatactataccctagagaaacactagcatatacacacagagacatacataagcatatttttacagcagcagtttgctaaagcaaaaacagatgaaaacaacacatatgtccaacaacagctgaacaggcaaataaactatgccagagctagctctacagtggaacattaggcagcagttaaccaggatgagccagatttatgtatgttggcatggaaaagacctcttaaatataatgctgaatgaaaagggcaaacaggactacactaatacactatgatcctatgtacttaaaaaaaaaattctgtagaattaaaaatttctgcaagtattaacttttttaaaaattggttctttcattgagcatttatattcttttacatataaaattttacgtaaaaaagattttatgaccgggtgcactggctcacgcctataatcccagcactttcggaggccgagacaggtggatcacctgaggtcaggagttcgagactagcctggccaacatgttgaaatccagtctctactaataatacaaaaaaattagctgggtgtggtggcgcacgcctgtaatctcaactactcgggaggctgagggaggagaatcgattgaacccagcaggtggaggttgcagtgagccaagatcactccattgtactccagcctgggtggcaagagtgaaactccgtctcaaaaaaaaaaaaaaaattaccaaaaagtttgcataaatgcacaataaaagaactgaaaagcctatccctgggcaggtacagagtaaagaaagataacagaacttcagcatttactatactgtttcttagtttctgctaagtattactcgtgtaaagtactaaagacaccagaaccagtgcttcccaaccaagtgagaaaactgctgaaaatgatcccaattttgtaaaagcagtaaataaaattctctagatgtacacttacgtttttatcggcatggggtgaaatggggaagaatacagccctagctgctgtttggggaaatgacaaggcatttcatggagacgactttttcatctttacattgattcaccagtacaagcaagcatgattacctttatactttttctaaaacgaagttaatttttttaatgagaaacgattacctggaatagtctccaattttagcctatactaactacagagagggaaaaccatctctactcactttgtcacctatccggcagaggtactcggcctttgccatcattgcatcgcgaatttcgctctctcctagattcttctctgcatcttccagctcctcatccaaacgcttcaactcatcttcatttgccttcttcattttattgagtaggtccacgtctatctgccagtcgagggatttgcacaaggcttcatagtaaggagccatgtctaacatgcaaaaagagggatgtgtgagtggggacacttgtgccctcaagtcaaagtctgcccacgtatttcaccccccgccccgccacaagtcatccaccagtctcttccccactaacaggaaggcatgcgatggcgcttaataatcggcttggcaaaacataaacgtatgctggtgggaggtttgcgtgacggccaatcctggcaatgccaacctctactagggctggagggagggcaatcctcggtttgctcttgccggattctgttccaaaagtcttcaaacagggaaagactttttatacacacatactcacatacatatgttcaaacatacacattcactacagaagggccagaaagaaccgaacccaaatttcccttccacaggcaagctgaactctcccacaggaataccccgcgcccgggagcagtccccactgacagaaagtcacggggcctttactctgtgcctagcacaggggtaaatattaatgcctcacgattctcccccaagctgcccttacaggggaaggcggcacagagagatgcagaccccgctgaggcaagtcgaggtcccccagggtatccccaaaccaaagcaaaaccctaagggccggagaagccaggcctggtctctgagaccccgtcagaggggtctggagctccatcaaaaaaagtccccgcaggctccggaacgcggggacggcccaggcctaggccgctgactcggcgctcgtgcgggcctcactgttatcgcggacggccgccatcagctcgtcgcgcacggcagcgtctccgcggtgctcgggcaggctgagcaggaagcgcagctgcgcgatacgcaagtcggggttcttgggcagaccctcctcctccaggttctccagcggcatcgcggcgaaggggacagcggctgacaggacacaacttggttacgaccggctgcggcagcggaagcgggaggagtcggcgaata

SEQ ID NO: 13296 - DNA, 262 bp, Homo sapiens
agagattgacagtgcctactagaaattggggggacatggagcagctgcttccagacatttgttaccagttttaaagagaggctgcagatctggacttgcatgtgaaatttagttgagatatatgtgtgtgtgtatatatatatgtatacacacacgtatacacacacacttttttttctcttcttaaatctggtatagcctatgtatctgtgggccatctttggctcatgacctgccattttgccacctttgatttttacca

SEQ ID NO: 13297 - DNA, 1046 bp, Homo sapiens
tcaaggaagtaatacatattgacatcattgaaacagcagcaccctctgagaggcaagcatttagtaggattttaaagaaacttgagaactgttacataaggtgatgaattgggcatagcatgtaaaattatatttaagcaaggaaatgatctctggtgttttaatattcaacttgattgcttcctcttgggttctgtgtttcccactgtgtgacctgagctgtcagaaaaccttaagaattttctttgcatcatttttccatgcagtttgtgtacatgtctcatgtacctcgtggcagccactggttttgttcatcaaatggtgggttgtgggatgctctcctgcagtctccctctaattaaagaggttaaattgccgtttgctcagcctttagttcctttccacagcttcctaggctcttaaaaattagcactatattcctttcagattaaaaaaaaacaaaaacaaaaacctgtttgctgtctttactgctgtggtcttgtctagaggcaaatctgaacaaactgattgaaaggggtgtttggtggctggtgttctctttgactaaagaggcttacatgtactgtggtacagtctgcttacttaaaaggtgaggcttgaattaaaatacagccagatagaaggccagactctaatcaaatgaggtgattagatcaatgaatgaagagaggagaggagtcaggtgttgcctttccctggctgttgaatagctgatgttccagattgccctacagtgttgtgttagggcatccaggagggatacttttcaggcttaggtacacctcagtctttaaaatgaggaattaggacacattcatgtgtgtgtccctaatctgctcctgagaagagaagtgcaatcagggtcttattttgtgaccactgacttgcacactgagacaaaagggccatctgcaagctgaaaatagtggattccttaaaataaaaactattcacatttgatggtgtggtagttttaataaaatgttcaagtgtcaagttcattttcatttataatctgagacagt

SEQ ID NO: 13298 - DNA, 1046 bp, Homo sapiens; identical to SEQ ID NO: 13297

SEQ ID NO: 13299 - DNA, 213 bp, Homo sapiens
taggaaatcacaagagtattgattggggaagtgataagtgtccatgaaatctttacaatttatgttcagagattgcagtaaagacaggcataagaaattataaaagttttaatttggggaactaataaatgtccatgaaatctttacaatttatgttctcctgccatggcttcagccggtccctccgtttggggtccctgacttcccgcaaca

SEQ ID NO: 13300 - DNA, 592 bp, Homo sapiens
tataggaagtatacttctttattgaaaaggagataatgtatcaggtaacttattaaagtattttctcaaagtttagtatctttaggaatacagtgcctcaatacaatataaaatattttgtaaataatagaatgaattcattttagaatttaaatgatgctaataaaatagaccattattctaaaagtttaactaatttagaatcaaccctggttgaaaataaagccttaagctgtttttttggaagactttaaatcctttatggctaagagatgacagacagggccgagtgcggtggctcatgcctgtaatcccagcactttgggaggccgaggcgggcggatcacgaggtcaggaaatcaagaccatcctggctaacacggtgaaaccctgtctctactaaaaaatacaaaaaaaattagccgggcgtggtggcgggcgcctgtagtcccagctactcaggaggctgaagcaggagcatggtgtgaacccaggaggcagagcttgcagtgagctgagatcacaccactgcactccagcctgggcaacagagcgagagagtgagactctgtctcaaaaaaaaaaaaaaaaa

SEQ ID NO: 13301 - DNA, 213 bp, Homo sapiens; identical to SEQ ID NO: 13299

SEQ ID NO: 13302 - DNA, 953 bp, Homo sapiens
tccacttttccttcttcctgttagagggaagctgtcccctgttgccatttctgaaacttgggcggacaatgtcgttattgtgttacaaacgatttgcgtctccagggcaggagttgggtgatatttttctgggagcctgtgccagggcgtagcccagtgttatctcatggtttctgagtgaatgagtgagtgagtattaaaacttcatatcaacatggagcctataacacagtggttctgaatctttcttgggggggaaaagaagagatacaagacccctagagagtatagagagtatgtaaaagggaagaatccttccccaaaagggaatgcacatatttacaatattgtatccaatttcagaaggtttttttaaaatttttaattttattgtttttttttttgagacacggtctcagtttgtaccccagcgtggagtgcagtggcatgatcttggatctcggctcactgcagcctctgcctcctgacctcaggtgatccacccacctcggcctcccacagtgctgggattacaggtgtgagccaccatgcctgaccatgactagtgttttgatgtgtggatttactacaatttatttgaccattctcctatcaatggacactttagttgttttagtacacctccctgtcccgtcacaaatcatactttgtaatgtttctggtggatatttcttgtaaccttcacaagtttatctgtagagtaaatttctagtttcaggattactggattggaagatgcatgcatttaaaagtgtgattgctgttgtcaggttgtcctccaaaagtgtcccctcagtttgtacctgtatccataggtttggagagtgtctgtttctccataccgtctcatctgaaatgaaaatttttacatgtttgctagtctgaaaggtgaaaaattgtatcttgtttttttttttttttttttttttttt

SEQ ID NO: 13303 - DNA, 7262 bp, Homo sapiens
ggtgggtgtcccagagcaggcggctgcaacgagacaggcatgttggagaggctgcccctgtgtgggaaggctttcgcagacatgatgggcaaggtggacgtctggaagtggtgcaacctgtccgagttcatcgtgtgagtgccactgctgggcgtgggatttgctctgaccacagcgctgcccactgcccaaccactgcctgaccacagcctgaccgcactctacccaaggcctcacccatgcctcacccacaacccaccgtaggccacccacagccctttcatgtgctgccccacactttgcccagggccccaaccacgctcctattcacactctgctcttggctctggccaccccacccacatccccctggcacatcactcacggccccgcccatgccgtgcccctgcccacggcatttgtgctccccacacccacagcgggttcccagcttcctaccccccattccgcatcctcactctgatgttctagcaattctacactgtgcctctgcttctccctctcctctgttatttaggaatcctccccatgcctgcttttcctcctgatccagattagtgccctgccctgggagtgtccagttcgggggttccctggcctgggggtgccctgtctgggaggtgctctgcctggagggtgccctgcccggggagtgtccagtttgcgggtggcctggcctggggggtgcactctcccaggggtgggtgctgccctaccccagggggtgccctggcctgggggatgccttgcctggagggtgctccacctctccttacagctggagctgggtggacattgtcatgtgtctttcttacagcaccagtcatggctgggtctgtcctcagtggtcagaggacttagaggaattgggttccaatggtttatatcaggtgtaattgtggacaacacctcatagtgaagggaggtccccttgttctagaagcttcccaagcttttcatctccttacctccttggaaattgctcatggcctcacagtcctctgccccaccccactccacctctggctttgcagtcttgtgccaccccctggtggctgctgccagaccctaaatgtgctggcctcatgcttttgcatgttagcaccccagcccctgtcttccgtagagacactgaccatggccctgccccaggaagcctccccggccctggccattctagtggcccagcagatgggggcttcttgaggctgtcacatctgcagccccactctgtgggggaactgcttgctgaaccaagtggaatggaattctgagtctgctgggaaggggtgctgggattcaggaaggggttttgcaggctcctcctggtcctcagtgagcctggacacaggcctggaatggacccactggtgggggtggagtcagggaagaggaggtcatagcttcgtagcttctggtcttgctcctctctgtaacccgctaaagccttggtaaagagactaaatagagatgtccagccgtggattgggaggacaggagtggaggcaacccgatgggcatttaggagccagtgagtgagtgggcaagagccactgactgagtgcccttggtgaagtcagacctgatgctggaaaaggggagctgggaacagccaggttgacattgcggagccctcccacgacccggccggcagcaccagctcccaagagagtggcaagagtagctgagaagcagtgaggtgtccagagccctcctccaccccagctggacactggaggtgtattcttggagctggtgacaccagggtttctgggccttcccatgtaattgagaacgtggcacagtgtcccagagagggaggctggagagagcggctgatacgcattatcttttgccactgggtccaggagggtggtctagggtaggattggagctgtcctttctgaggagtgagaccagccaagaggaaggacctagaagcagtgacccccccaacccctggaagctctggggacaagctcttctgcagggtcccagtgtctcatcagctctcagtccccactcccagtcacgagtcacttccaagcagggtccctggaaatctgacctaaggctctgaccctgaaggacagagaccagagagatggaaccaagcaaacccgggggccatgcaccaagaagaaaactgcaaacgtcacgactgatatcttcagagggcaacaactatctctcatgtgatgaatgagaacaaagaaagaggtttagaaatggaagatgcaatagaagtgaaatggaatagaaaggttggaagggagatgttgaggaaatctcccaggaataggagagagagacagagaagatgatcaggaggtcagtggtcagtccaggcgtaacaccaagatagtaggaattctagaaagagaacaggagaatggaaggataaagggcccttgccaggggctgagggcatgagcttgcagccggtgagggcttgcccggtactagcacgagggaggaaaatgtcccacatggaccctggaatatcagagctgtggaaacaaaggaaaacttctacacctatccagaaggaggaaaaaaatgagctctaggttggagatgaggggatcagaggccttcaggctcccccaccgcagccctggaaaccgaggactgtgggatgcaaggacctgagaatttcggactgtgatttctcagctagtgtgctatttcccgccaatttgtccactaattagggagaaacgaaaatactgtcagacgtgtggcacctccagcatctgattcccacatacctttctcaagctctggcggctgtgcgccaaggtgtggagcaaaccacgacaaaagaagctatgagatttggggagcggagccaaggcaggagagggaagccccagggagggcggtgccccagcgtggcagtacaccctgggtggaggcagcctggcccaggtggagggcacttgatgcttacctgacatggtgactgcctgcccatgccctgcagcccagctcagtcaagaatgaaggacactcctttctttcccctgaatgttcattctgctttggtccccactgaagcagggtgggccttggtgagcttagaggagaggtggcttgctcccctcaataggactggtccacatgacgaccccatcaggagtcgagtcatggctgggaagaccctattccccaaactcgcccatggcctgcctgtggccttccctggggaggagtctcattgcccctcggggcaaccagagcgtgtcctctcctgggaacctccctccaatagcagcaatgggctccttctgtacccagttaaggagcattgctatgggatttccaaatgcaacactatattgcctgggaacacactcaggtggtgaaacataaaggaaggtgggcaaacaccccagaggtgggtggggggagagggagtctgactggggggtttgcccggcttccagcctgctgggctcctctccttcccatcctgggttgtggtgcatcttttttagggagagtgctctggggagcctgactgaaggaggagtggagaggccccagattatccaggggatgaataaatcataagtagttcccggttttctagagaagcactgaatgtggacctctctagatatgtgacaaaaatgcagattttgtggatccacagagatgggtgctgtgctcagctctgccccaaacctaacagctggggtgggctcaccccatgacctcctctgtgccaggcacttgctggggcacatggacctcaactcatttggttctctcaaccacctgataggataagtgttattaaacccacttacagatgaggaaactgaggtccagggaggataaatgacatggcccataccacaaagatggtgagtggctgagctggagttggagaggccctgccatgttggctctgcaacctgagcctgaagccactgtccatgctgtcttctgggattacctctgctccgtgggcttctccatgtggcctagctttggctgggagtggggtttgggaacagcaggggctttcagccctgcctcacctcctcttgggacggttctggggctagacatcactcctcttgccctgtagactcgctgtccacagagggtcttctccagggtctgtctggctcatctcagccctggggatggttgttggggggtggcattcctgggtagcagttcagtggaatgactttggaggcacagaggttaccgcatgtgattctcatcacacacatagatgctgggaacttctgaaggtgaaggctgttgcagggtgttgttagacggctccccagctcctggatcagctggcggggggttggggtggacagcaggctactgaatctgaggccctgtgggagaagcaggtcagggaagatgagggtttgtccatggacctagctgttgaggtgtctctaatgcctgggcatgtctcaggtgctgcattgtggctgaggcccaggagagccaacagctttgtacttggattcgaggctgtttcttttgctctggctgttctctgctgacactacctggaaaggcacaggtgtgtgtctgacctacattccaaggtgctgagagccagccttggatcagtcaggagctgggctgagtgactgtacctgggcttcccagacccttcctggggcatggggttgggagaccaggagaaccctgggtggagtaggtcagagtccctgtttcctacccctttctgatgctttgggaaatctacgcccagatgatgttccatgcaggaggcagctctttcctgttgatgggccagatcagtggctccctcctgggacagcgcgggaaggaggagatgggctactttcccatggggaagccgaggcaggacccttcacactcctgcatctgtactcatgcagcacagacgtggggaagtgctagccctgcacagagggggtggcatctgggcaggagtccatctagcttcgtctagaacatcctgaatgagtggctgccactctaggccttgcagaccccaatgacagggaggtcatcacctccacaggctgcccattggaacaggtggtggctgggaagtcctttatgctgagttgacctctgggtcttggtggctatagcccttggtcagcatgaggactgtccagagcctgtgctgggcggtcatggagcatcatgggtggtttgctgagtgcccttcccatctttgatctcatggacagggggacccacaggagggggctccacatgtcctgctagatggggctgaaggaggcaacttctgagtaggagatgaagaggcagggactggggctcacaggtctgactcccacttggccaccacctggcacatgagggcaggctgacttgattaggaggtggctggcccctggcctcagagagaccctcctctcaggctcttagggtatcctggatgatgaaggctttgcaggtccaagcggctgtgatccaggcaccctttggccctggagaagcatggcttggtgtgtcctctgggcagacctgcgtagtgcttagaggtccagggaagctgggctgagaccctggatcctgggagctcatggcctcaaaggcagcaagtcatggtcattgtgatgcaaatgtgggcaggggacacagggaatgggtcatgggcacagatgaccctgtggccagaatggggattttccaaggctgggctgtgaataggtggccaaatgggactgtacccaagccaccccacccatcttcctggcctcaggtcagggcaggtgtgaggggggatggcgagagcctggctttcaccccctctgcttttgcaggtactatgagagtttcaccaactgcaccgagatggaggccaatgtcgtgggctgctactggcccaaccccctggcccagggcttcatcaccggcatccacaggcagttcttctccaactgcaccgtggacagggtccacttggaggaccccccagacgaggttctcatcccgctgatcgttatacccgtcgttctgactgtcgccatggctggcctggtggtgtggcgcagcaaacgcaccgacacgctgctgtgagggtcccggtgagatggagtgggtcacacctggcaagctggaagaaagttccctggggatgggagagcgggtgggtgctgccaatctccagctactgtggccacaccccacctggtcatgggcagacccctcccttcctgggctgacctgctccctcgaggccagcctgctccctggctgaggctcaggctatccgcccaagctctttgctcattctagggccagtggaggaaaatgtgataaggccagagcttgtgtgctgggcacagaaatcacctgctgcatcctgtgctccgcaggctgggccggagcctctgcccgcaggtttctatgctgtttcttagcacagaatccagcctagccttagccgcagtctaggccctgcttggactaggactccttgcttgaccccatctctggttcctgccctggctcctgcaccagccccagctcctgcctacatccaggcagaaagataggcaggggctcttggaagacgttccgtgctgtgacctccgagccctcctggtgggaagacagctggaaaggctgggaggagaagggaggggctgggggttcccaggagccatgcgtggcctgcagagtccattccatcatgatgctgtgcccgctatgggctgtgtccatgaccagaggctggagtgggggtgtgttagagcccctcaccgggacttgctgtgcggatggggcctgggcctccttcctacaggggctcctctgtgggtgaggggccctctggaatggcatcccatgagcttgtggcctctatctgctaccatctgtgttttatctgagtaaagttaccttacttctggaatttcctgttttgtttcatgttattcagagagacggtgcatctcttgggactgatgagtcccctgtacatattgtacagatagggaacaactgaggttctggaatcccagaatgtcagcgcttagggggctcagagagtgttacaataggagaggggcctgacaggaggagggacttgcctagctactcgcagccccttgggcacttcccatccctgacccattggtttgaggatgacagggaagatttctctctcttctgttttccctttgcagctgccttgggcttgctaggacccctgcctgggttttctggggacc

SEQ ID NO: 13304 - DNA, 1552 bp, Homo sapiens
gaatgaagaagatgtttgcttcatagtcttgaatagaaaagaaggctcaggtctgggattcagtgtggcaggagggacagatgtggagccaaaatcaatcacggtaagtgacagagtcattaggctctcaggaaaatcccccctcaagcagcctcagaatgtgatcagggcacaaattccaatcagcgggttcagagattgctggatttcattcccagctaccaacataaaaagggagaagtgggagaagtagtacgtaaggttttcgttgacaaaagacaagcatttttaacacagagctgacatgtataggccatttccaatccctataaacacaattcgctatagccttataatttacctccatattttaagcagtagaaaacattagaatcaactggccaaacttgtgtttatacaattactcccgtctcaaaaagtcactcaaaattttacatcattcaaaagccttgcaggaccatccagagggtcaccttcactgcacgagcccaggcctcattcatcttcgtattcccattgcctcctggatgccaggcccatgtcagacactaaaaaggagttaaaaaaaaatgtgtggagacactggcattgacatttgtgttccatcccccgcactgaatgtatgtttttttttataaagcaagtgtctaccttagaaagttcctttactacaagacccggcacggtggctcacgcctgtaatcccagcactttgggaggtcgaggcgggtggatcacctgaggtcaggagtttgagaccagcatggccaacatggtgaaaccctgtccgtctctcctaacaatacaaaaattaacttggcatagtggtgtgtgcctataatccaagctactcaggaggctgaggcaggagaatcgcttgaacccgggaggctgagattgcaccactgtactccagcctgggtgacacagcgagactccctctcaaaaaataaaaataaaaaaggaaggttcctttactacagatacgcagttagttactatctcccttttaccggaaatcgtaagtgaatctggtttttgttcccttttcctttcctcatcccaggtccacaggtgttttctcaggggcggcttctcaggaagggactatgaaccgaggggatttccttctgtcagtcaacggcgcctcactggctggcttagcccacgggaatgtcctgaaggttctgcaccaggcacagctgcacaaagatgccctcgtggtcatcaagaaagggatggatcagcccaggccctctgcccggcaggagcctcccacagccaatgggaagggtttgctgtccagaaagaccatccccctggagcctggcattggtaagatgatcatttcaacaaccagcaggctgtgagctactgcagaaagaggagattctggttgaacatgaaggaaaataacagctaactaacttctagatctgaaaaattaaatgtagcgaagtctagtgtgtttggatgctgcttacaaaagcagtgttacaaataaattagaaaaaaattagaaaattagaaa

SEQ ID NO: 13305 - DNA, 24268 bp, Homo sapiens
ttttttttttttttttttttttttagtagagatggggtttcaccatgttggccaggctggtctcgaactcctgacctcaggtgatccacccgcctcagcctcccaaagtgctgggattacaagcatgcgccaccacgcccagctttctgaaaaagaaaaaaatatttgaggttgtttataattttctagtttttaataattgaggggctgctttcttatattatcccttttatctcccctacaacctctcctgtgtatgtaccttctgtttacgttctccacgtagaactggacagctcctcggacctcatctcttccccagggaagaagggggccgctcatcctgaccccagcaagacctctgtagacacagggcaagtcagtcggccagagaatcccagccagcctgcatcgcccagggtcgccaagtgcaaggccaggtctccagtcaggctcccccatgagggcagcccctccccgggggagaaagcagcggctccccctgactacagcaagactcgatcagcatcggaaaccagcacaccccacaataccaggagggtggctgccctcaggggagcgggacctggagcagagggaatgacaccagctggtgctgtcctgccaggagaccccctcacatcccaggagcagagacagggagctccaggtaaccacagtaaggctctggaaatgacaggaatccatgcacctgaaagctcccaggagccttccctgctggagggagcagattctgtgtcctcaagggcaccgcaggccagcctctccatgctgccatccactgacaacaccaaagaagcatgtggccatgtctcggggcactgctgcccgggggggagtagagagagccctgtgacggacattgacagcttcatcaaggagctggatgcttctgcagcaaggtctccgtcttcccagacgggggacagtggctctcaggagggcagtgctcagggccacccaccagccggggctggaggtgggagctcctgccgtgccgaaccagtcccggggggccagacctcctccccgaggagggcctgggctgctggtgcccccgcctacccacaatgggcctcccagccttcggttttagattcaattaatcccgacaaacattttactgtgaacaaaaactttctgagcaactactctagaaattttagcagttttcatgaagacagcacctccctatcaggcctgggtgacagcacggagccgtctctgtcatccatgtatggcgatgctgaggattcttcttctgaccctgagtcactcactgaagccccacgagcttctgccagggacggctggtcccctcctcgttcccgtgtgtctttgcacaaggaagatccttcggagtcagaagaggaacagattgagatttgttccacacgtggctgccccaatccaccctcgagtcctgctcatcttcccacccaggctgccatctgtcctgcctcagccaaagttctgtcattaaaatacagcactccgagagagtcggtggccagtccccgtgagaaggccgcctgcttgccaggctcatacacttcaggcccagactcttcccagccatcatcactcttggagatgagctctcaggagcatgaaactcatgcggacataagcacttcacagaaccacaggccctcgtgtgcagaagaaaccacagaagtcaccagcgctagctcagccatggaaaacagtccgctgtctaaagtagccaggcattttcacagtccgcccatcattctcagctcccccaacatggtaaatggcttggaacatgacctgctagatgacgaaaccctgaatcaatacgaaacaagcattaatgcagctgccagtctgtcctccttcagtgtggatgtccctaagaatggagaatctgttttggaaaacctccacatctctgaaagtcaagacctggatgacttgctacagaaaccaaaaatgatcgctaggaggcccatcatggcctggtttaaagaaataaataaacataaccaaggcacacatttgaggagcaaaaccgagaaggaacaacctctaatgcctgccagaagtcccgactccaagattcagatggtgagttcaagccaaaaaaagggcgttactgtgcctcatagccctcctcagccgaaaacaaacctggaaaataaggacctgtctaagaagagtccggcagaaatgcttctgactaatggtcagaaggcaaagtgtggtccgaagctgaagaggctcagcctcaagggcaaggccaaagtcaactctgaggcccctgctgcgaatgctgtgaaggctggggggacggaccacaggaaacccttgatctcaccccagacctcccacaaaacactttctaaggcagtgtcacagcggctccatgtagccgaccacgaggaccctgacagaaacaccacagctgcccccaggtccccccagtgtgtgctggaaagcaagccacctcttgccacctctgggccactgaaaccctcagtgtctgacacgagcatcaggacatttgtctcgcccctgacctctcccaagcctgttcctgagcaaggcatgtggagcaggttccacatggctgtcctctctgaacccgacagaggttgcccaaccacccctaaatctcctaagtgtagagcagagggcagggcgccccgtgctgactccgggccggtgagtccggcagcgtctaggaacggcatgtccgtggcagggaacagacagagtgagccgcgcctggccagccatgtggcagcagacacagcccaacccaggccgactggcgaaaaaggaggcaacataatggccagcgatcgcctcgaaagaacaaaccagctgaaaatcgtggagatttctgctgaagcagtgtcagagactgtatgtggtaacaagccagctgaaagcgacagacggggagggtgcttggcccagggcaactgtcaggagaagagtgaaatcaggctctatcgccaggtcgcagaatcatccacaagtcatccatcctcactcccatctcatgcctcccaggcagagcaggaaatgtcacgatcattcagcatggcaaaactggcgtcctcctcctcctcccttcaaacagccattagaaaggcagaatactcccagggaaaatcaagcctgatgtcagactcccgaggggtgcccagaaacagcattccagggggcccctcgggggaggaccatctctacttcaccccaaggccagcgaccaggacctactccatgccagcccagttctcaagccattttggacgggagggtcaccccccacacagcctgggtcgctctcgggacagccaggtccctgtgacaagcagtgttgtccccgaggcaaaggcatccagaggtggtcttcccagcctggctaatggacagggcatatatagtgtaaagccgctgctggacacatcgaggaatcttccagccacagatgaaggggatatcatttcagtccaggagacgagctgcctagtcacagacaaaatcaaagtcaccagacgacactactgctatgagcagaactggccccatgaatctacctcatttttctctgtgaagcagcggatcaagtcttttgagaacctggccaatgctgaccggcctgtagccaagtccggggcttccccatttttgtcggtgagctccaagcctcccattgggaggcggtcttccggcagcattgtttccgggagcctgggccacccaggtgacgcagcagcaaggttgttgagacgcagcttgagttcctgcagcgaaaaccaaagcgaagccggcaccctcctgccccagatggccaagtctccctcaatcatgacactgaccatctctcggcagaacccaccagagaccagtagcaagggctctgattcggaactaaagaaatcacttggtcctttgggaattcccaccccaacgatgaccctggcttctcctgttaagaggaacaagtcctcggtacgccacacgcagccctcgcccgtgtcccgctccaagctccaggagctgagagccttgagcatgcctgaccttgacaagctctgcagcgaggattactcagcagggccgagcgccgtgctcttcaaaactgagctggagatcacccccaggaggtcacctggccctcctgctggaggcgtttcgtgtcccgagaagggcgggaacagggcctgtccaggaggaagtggccctaaaaccagtgctgctgagacacccagttcagccagtgatacgggtgaagctgcccaggatctgccttttagaagaagctggtcagttaagtaagtatctgcccactacttttatttcagataaacttgtttcattttggaatagttttagatttatagaaaagttgcaaagataatgcagagttcccacttactttttttttttttttttttttttgagatggagcatcgctctgtcgcccaggctggagtgcaatggcgcgatctcggctcactgcaacctctgcctcccgggttcaagcgattctcctgcctcagcctcctgagtagctgggattacaggcgtgcaccaccacacctggctaatttttgtatttttaatagagacggggtttcaccatgttggtcaggctggtctcaaactcctaaccttgtgatccgcctgcctcggcctcccaaagtgccgggattacaggtgtgagccactgcacccggccacttcttacccactcttcctaatgttcacatctctcataaccacggtccattcgtcaaaagtaagaaattaatgttggagcaataccattaactacagacttcattcagattttgctgaataaattctgctaatatcgtttttctgtcccaggatccaggatactacattccattttagcgcccttggtttttaatatcactgctggaaaaataaaagtgcctgcagggaaacatgtttaccaaagtgtcgctctgaggagaggcttctagaggacatggcacttaagcaaaagcaacatgagaggggcatgcagaggaagagagagcacagcacgggggaatttggactttggaggtggctggagttaaacggagaatttctaacatatttaaaaatatttcacttgaggccagccgtggtggctcacacctgtaatcccagcactttaggaggctgagcagggcagatcacttaaggtgaggagttcaagaccagcctggccaacatggtgaaaccccatctctactaaaaatacaaaaattagctggggatggtggcaggcgcctgtaatcccacctacttgggaggctgaggcaggagaatcgcttgaacccaggaggctgatgttgcagtgagctgagatcgcgtcactgcactccagcctgggcaacagagtaagactcaatctcgaaaaaaaaaaaaaaaagccaggcccagtggctcaggcctatagtcccagcactttgggagaccaaggcaggcggatcacttgaggtcaggagttcaagaccagcctggccaatatggtgaaaccctatctctactaaaaataaaaaattagccaggcgtggtggcaggtgcctgtgatcccaactactcgggaggctgaggcacgagaatagcttgaacccaggaggtagaggttgcagtgagctgagatcgtgccactgcactccagcctgggtgacagagctagactccatctcaataaaaataaaaatatttcacttgaacatatgtattgaatattttaaaacatgtcagaagtgtcctgttaagctccagcattggtcccataacttcttgaggggatctctgaattcatagcagttccccttgccattggcagtgaatgacatttctgttcagcactcaggatttattcttccattagtttggaatggaagttttgaccaaaagagagcagaaaatacctgttctcttttgtatagtagaaaggagatcattttaaatgcattcttataaaatgaagaaattgcttttttctttaatgttcttcaaatatatttatattatttagtttggatcaacttctagtctcagcgggggaccagcaaagattacagtctgttttatcgtcagtgggatcgaaatctaccatcctaactctcattcaggaagcgaaagcacaatcagaggtgagtgaaacacagaaagctcaggaacatgaattgcggccgcgtgagtgcccaggtatgtgctgcctgcccagacagccgaggagagcccgccccgagtcctggagagggaggactgccttgggttgcgagtttcacagctcagtctgactttggcctcacgtgctgctagccagcttcagaagctagaccttgtcttgaatgttcaggtgccagatgggtgtcactgctgttttcatcccccaagtagcaactagttaccattctcctaactcctatgtgtggagtttgtttgcagagagtcctcaaagcagagctagtcatctcggaaatacctctcgccacctaactgtggacataaactagtcaagggagccacctgctggtgagagaagagttacattggtgtagtcccgccgttgccctgcaaatatggtggacccctgaacaacatgagggttggggcactgaccttcgagcagtggaaaatccacatataacttttaactctcccaaaaacttaactactgacaacctactgttgaccggaaaccttactgataacataaacagtcaattaacacaagttttgtcagttatatgtattatatactgtcttcttacaacaacgtaagttagagataatagaacgttattaagaaaatcctaagaggccaggtgcagtggcttacacctgtaatctcagaactttgggaggccaaggcgggcagatcacttgaggtcaggagttcaagaccagcctggccaatatggtgaaaccctgtctctactaaaaatacaaaaattagctggacatggtggtgggtgcctgtagtctcagcgactcaggaggctaaggcgagaggattgcttgaacttaggaggcagaggttgacatgagctaagattgcaccactgcattccagcctgggtgacagagcaagacttcatctcaattaaaaaaaaaaagtcataagagaaagtgtatttactattcattaagtggaagtggttcatcataaagggcttcatccttgtcatcttcacactgagtagcctgagaaggagggaggggttggtcttgctgcctcaaggataaagaggctgaagaaaccctgagtgtgagtggacctgtacagtttgagcctgtgttgttcaaatgtcacctgtagaagagcatctgaaccctggagtacaaggaattacaaataaaatctttcagtaaatcagttgtgacaataaacattgacagaagaaaccacaggttcacatctaggatactaatctgaagatcaatttcttggggctatacgtagagatttgaaccctaatgaatgaatattttctatttagagaaataaatatgaatgtttctttagtggtagtatacctgggtcactgaagtcatctaagaatgctgttccagaaattcaaatatagaggggctgtgtggtttctcagccaacagccagccttggcacctagtaaggagttggccaggaggcgaggagagaggttggaatagaggagaccagtcccttcaggttccactcccttctgattctcagccgctgatttgggtctgtgcagttaagacatgccttgacaggaggatcatctgaggccaggagttcgagaccagcctcatcaacatagtgagacccctcatctctcaaaaaaaaaaaaaaaagattaaatttaaaaaattagccaggcgtggtggtatatgcctgtagtcctacctacatgggaatctgaagcaggagaatcacttgggtccagtagtttgaggctcagtgagctatgatcgtgccagcgcactccagcctgggtgacagagcaagacctgtctctgaaagaaaaacaaaatgtcttgagatgctaagcacttccgctttcagtaaaagggaatagcccctcatctctcttcctcctcccacttgttattacaataaggaaggatttcatgtgtgaaagtctcattctgagaccaccagtcaagggggcacaggtggggtcacacgttgccaggccccctttaccccagacattttagtgttagatgaaatgtcagaggagaagaccagactgtccagccaaccacaagcaagatgtacatcttcaggaacctcaaacaaagtatggccagcatgccacagtgctgcccgagggtggcttattctagggccttcctcacccctactactcacgctcaccacgaggcagggttgtggtttggtttgaagatcattcctacatatcagaacacggcgttcttttccctttattttctcactgtcttcagagaggagcgttgagcagggctatccttactctgccatcctcagtctagaagcttcctgccttgctttttccaatgagtatggtttgcaggtactaaaaatagaactgcacaaaactattttctgtgtccttggcagtgctgtgagagattcgaggcttcgaggctgaaaacaaaccctggcctcctgacttcaacacacccaaaccttggagagctcttgatggttgatctggccgccctgagactgtgctgaggctctcagaggcaaaatttggcgcaatagtcagcttctagcatatctgtgtccttaaacaccactggaaaaaaatgtgaatacattgaaatttttgtgatttaacttgtcctggaatgcaggagggcctcattttctttttttttttccttctcctttttttttttcttttcttgagatggagtctcgctctgttgcccaggctggagtgcagtggcgtgatctcggctcactgcaagctccacctcctgggttcacgccattctcctgcctcagcctcccgagtagctgggactactggtgcccgccaccatgcccggcttttttttttttttttttttagtagagacggggtttcaccgtgttagccaggatgggctccatctcctgaccatgtgaaccacctgcctccgcctcccaaagtgctgggattacaggcgtgagccaccgcacccggcgtaggaggcctcattttcaaatattgtctctttgctcccataagacattgaaatatctgagaagtgttcctattttcagcaccacattacctcctagaagctggacaaagaccatttactgggtcccgtattcccatttttgtttggaaagcttagtcaacctctttctccccatcaatccgtgtgtgagcatacatatggttgaaggtgcccatgaagtcaacctcccaactcccccaaaagttctgcgggacagtctaggttttggtttgagtgaactttgggggttttttgagacagagcctcactccatcacccaggctggagtgcaactggcatgatctccactcactgcaacctctgcccgctgggttcaagcgattctcctgcctcagcctcccaagtagctggaattacaggtgtccgccaccacgcccggctaatttttgtatttttcagtagagacggggtttcgccatgttgactaggctggtctcgaactcctgacctcaggtgatccgcccgccttggcctcccaaagcactgggattacaggcgtgagccactgcgcctagccatgctatttttttggcatcagttaattaattgtacctgaaatccaatgatggggagggagatgtagaaaacatggccttgatatgctcttatcctgcctcttgccactgacgcttatctttctgctgttgctaggactggctttgctaaattgtagacttaaagaattacagaataaaggattcccatcatgatcaaattatgtactatgattttttttttttttttttttttttgagacaaggtctcactctgtcaaccaggctgaagtgcagtggcgtgatcatggctcactgcagccgtgaccttccaggcttaggtaatcctcccacctcagcctcttgagtagctgggactacaagtgtgcaacaccacacctggctgatttttgtagagacagggttttgccacattgcccaggctggactcgaactcttgggctcaagagatccgcccccttggcttcccagagtgttgggattacaggcgtgagccaccatgcctggctgagagccaaagaacctttagggcctgtggtgaaaagcccctccaagaggactgacatcagagcttccttactcctggcccaaggggatatgtttttctttcttaattttttgcagctgtagctcaaaggataatttttgtttgttttcactagaatgaagaagatgtttgcttcatagtcttgaatagaaaagaaggctcaggtctgggattcagtgtggcaggagggacagatgtggagccaaaatcaatcacggtaagtgacagagtcattaggctctcaggaaaatcccccctcaagcagcctcagaatgtgatcagggcacaaattccaatcagcgggttcagagattgctggatttcattcccagctaccaacataaaaagggagaagtgggagaagtagtacgtaaggttttcgttgacaaaagacaagcatttttaacacagagctgacatgtataggccatttccaatccctataaacacaattcgctatagccttataatttacctccatattttaagcagtagaaaacattagaatcaactggccaaacttgtgtttatacaattactcccgtctcaaaaagtcactcaaaattttacatcattcaaaagccttcaggaccatccagagggtcaccttcactgcacgagcccaggcctcattcatcttcgtattcccattgcctcctggatgccaggcccatgtcagacactaaaaaggagttaaaaaaaaatgtgtggagacactggcattgacatttgtgttccatcccccgcactgaatgtatgtttttttttataaagcaagtgtctaccttagaaagttcctttactacaagacccggcacggtggctcacgcctgtaatcccagcactttgggaggtcgaggcgggtggatcacctgaggtcaggagtttgagaccagcatggccaacatggtgaaaccctgtccgtctctcctaacaatacaaaaattaacttggcatagtggtgtgtgcctataatcccagctactcaggaggctgaggcaggagaatcgcttgaacccgggaggctgagattgcaccactgtactccagcctgggtgacacagcgagactccctctcaaaaaataaaaataaaaaaggaaggttcctttactacagatacgcagttagttactatctcccttttaccggaaatcgtaagtggatctggtttttgttcccttttcctttcctcatcccaggtccacagggtgttttctcagggggcggcttctcaggaagggactatgaaccgaggggatttccttctgtcagtcaacggcgcctcactggctggcttagcccacgggaatgtcctgaaggttctgcaccaggcacagctgcacaaagatgccctcgtggtcatcaagaaagggatggatcagcccaggccctctgcccggcaggagcctcccacagccaatgggaagggtttgctgtccagaaagaccatccccctggagcctggcattggtaagatgatcatttcaacaaccagcaggctgtgagctactgcagaaagaggagattctggttgaacatgaaggaaaataacagctaactaacttctagatctgaaaaattaaatgtagcgaagtctagtgtgtttggatgctgcttacaaaagcagtgttacaaataaattagaaaaaaattagaaaattagaaaaatccccccagtagttcaagctgtactgtggaagatttaaaatgactgcagaacagtttccctaagtgtcctaagaaggaatctcttacattcacagcctcttgttaggactggtaaggaaaacaggaaactacgtgacggggcgagcagtgttgaaggagaaattccagaactaagatttatccttgggaaacagcaaggttgtattctttcctggtttagaagaaaagaaggaaatgagggggcaagagtattttgtgtctgaaaacagaaattgcagccttagtcaaccaagaagaactcactggaagaggtttagaaacagattttctacgttccgtccatattcagagcctcagaaccacgtgcagcgtctgtttctgcagtgcgagctgtttaatgccctgttaagtactgcagatgtctggagtgccgtgcatcttggcattcaggggtgacgtctttttttattcgagagggcaaagcagagggtatgggttaggcagtgccttctgggaggggccttttgttccttctccacatctctccctgataagggtagctggattcctttctacaacttggcttccttgtggcctgagctgtttgtagtccttgctgaaaatggctccgattccatttaacaaatgagaaacacttcttgtccagatgcctccatggtccccagtcttccttctgtgtcatttcactttccctcttccagagggctgaggccctcctcaatacagggaaacaccttggtcatcagatcttgtcatgcttgcctttgccccaaaactgtctcgaccacttggtggactttcagtgggatccttgtaaactgtcaaaggaaaccacttcatcctcacagctgccagtttttaagcctcgtgaactcagatctggatggtccttctgtcatttataatcaatcactcagtattcctgcagcaacttcagggcctctggtcttgaagcagaccctgcagagcaatcaatcaaacgctgagcgcctggagggcttaacctcgctcagtttcctgttcttcagtctccctaacccaggtctacccggtcctatgcagttatattccttaccatacactgacagcgtccagctgggggcccggtgcagtaagctgcacagtagagatgctgggacgcttttaaattcctgatgcccaggaaattcccagcttaattaaatcagaaatgccgcagtgggggccagacaccgtttcacgttcccaggtgactccagtatgcagccagactcgagccactgcaatagacccattttcctgttgaaaaatcatgctccccccagtgttagtaaatgtccttcagaccctgtggagtggccttctttaaaccacgacaatggactggcctttatgtccaaaggagacaatgctagcttggcttcagccctagtgaacagtgaacagaggaagcaggcagtttaatccatccgtggtccttcctctgcctcccaattaactaagtgtgcctttgcagtcaactctgacgtccttggctggtaggcaggcaagggagggaagtacaaggcaagtttacaatcctgattcaaaccagcccactatcccgaaaccagcacacagagccggcatcaccatggaaacacatttcctcacagtggagcaagatgccagtagaggcagcgagtgtgtttgtgaagacagccatagccaggggcagggtttccctttgcaggagcaggagtggcaggagcggggaggcaggaagctctctgggttcctgggggctttggagtccattctaacagtctcacatgagactgggcattttggtgctgccaagtcttggtaccagaggatgatctgctgctgccattagcagccagggttggcagaaaatcaaatttggagtccccaagtgtgacttcagtcctcactgagaagtgcacagccggtgtggggggcttaacaagagcactttgctttctggggatttctgcttgggcataaaagcatttgccaatgcttgcagaaaacacagaacaaaggatgcaagtacagcagcaacacagccaggagggcagccccagaattgggaggccaacagtgctactgggctcaagtgctgttataagtaagtaagtgccccagggtagatgggacttgagtgtgccagaagtacatggggctggaggcgatgcatcctgggggacttggacatgtggcatgatgaacaaccctgtcattttcatcttggtgcacgctgcggctgcagggagaagtgtggctgtacacgatgctctgtgtgttgaagtgctgaagacctcggctgggctgggactgagtctggatgggggaaaatcatcggtgacgggagatgggcccttggtcattaaaagagtgtacaaaggtaatgttctagacaactcagtcagccttctctcacctgtcatttttccatggacgtctcaatgaaaaaaatgccttccatttagaaatcaaaaaacctaaactgtttttaatgctttgtgacatacaaggtttattctgtatggacatgtattaactcatgccatccacgtggcaactctattgggtgggtgtcatcattatccctattttacaaaaggagaaactgaggcacgtagggtcacacagctgtaagtggcagaaccaggctccagcccaggcagtctggccccagagcatctgtccctgacccctgtactgcagcagttccttactccgggcccctctctctgatgtgaacacaccacactaagtaacatcactagacttgccagtcaggagtacttaatactggccaagatctcattgacttaaaatactacacttgtaaatgctagactgcaagaaaggaatacagtccaagcatagcctttgtgggaaaaaaaagatgggggatagatattattgaaatgcttggtaaatatccatctctttatcaacttgcataattcattttttggtcttgggcggtttttcaaaatcttatattaactcataattgtactaataatattaacagtataattgtatgaacaatattgatatgtaattatacttgcaaatagatcagaaacccatttaaagttacagtatgtaacagagtaagtaggtcagcaaataacaaggtcaattcttcttagctaaggattgttgtttctttaaatgaccatctagttaatgaccttgagatatttctacaattgcatagtaatcccaaaacctctctccactcttgacctatagtgttaataggaaaaaatacttttaaaaatgtatagttacacttaaaaaaaaacccctctatggatcaaaagtggaaatgaagcctctgtggtaagcagcgctgcatccttggggcccagaggaagcggaggatgacagagaaatgtgcactgcaggctggggcccacccaggagcaggggcgctgcagactcagtgcccacccaggagcaggggctcagcacccctgtgggcagccagagcgaagcatctcgtgatgcagaggcctgggacctgctcttttgccagtaaactgtggtcacaacaggtctgcgttactcgagtggcagccaggataggctgcctgctcccaacgcccggagcaagcagaagacaggcataaatcaggagtcaggtctctgttatgtgtgaacctatggtaccagggtgaagagaaaacctcagactcatcaagttaactgttcaagttgacagagcagcagaaggaggagaactaggctcaggcaagcatgtggcaactcgactataagagccctcacaacagaaagctctcagacgaagggtacagggcaacatccattgccagcagacccgaaaaacaggacaccccattcatgacagaggcaggaatgttacccatgaaacaggaccgaagagggtattcagaaggagcaagcaaatatgtaaaaaaaacaaaatgcaagctgggtgtggtagcgcatgcctgtagtctcagctccttgcactgcttgagccccaggagttcaataccagcctcaacagcagagcaagaccctgcttctttaaaagtaaaaactaaatgcacatacaccctcattagtgaaaatggagttaaatgtatttttaaattaatgagtaaaagtaaaaaatagactaaatccatgtgaagatagatagaatttgtaaaaacagaacagaagaaaccattaaaaaatgcagtatagggaaataaagagatgactacaaaaaggtaatgaaagagttccagaaggaaaaaacagaatgagaggaaatatttgcagaaatcatgactaagaattttccagaagtgaaaaaatgacaggactatgcagactgaaaaactcatcaaggggcaaaacaatctgaatgtatttatttaaaacaaacaaacaaacaaaaaacaagccttgttaggcagagtggtgcacacctgtgatcccagctacttaggaggctgaggcagaaggatcgcttcagccctggacttggaggctgcagtgagcaggactgcaccattgcactccagcctggatgacagagtaggaccctgtctccaaaaaaaataaaattcaaaccttgatataataaagtttcagaatataaagaagaaaatctagaaagccaagagaaaattctagtttgctcactgcatacaacaatcagagtggcggcatcaatgcctgaagccagcaacaccttcagaggactgagggaaaatgtccatcacctgaaaacccagcacccagctaacctgtcattcaatagggtagctaaaatggaggtattttaagacactcctgaggggagcgggagtggccgccttcgtggttggtcacaggacacgtagcctctgcagtccaaagggacacaacccaaaaaagcgtgtgagcctgcgaaccgaaggaccagggcagacgctgactaaagcagcacatcggctggggaagccaggcttcgggaccccacactagaagaagccacaggagagatgacatccttcagatctgcctccagcaaagcaagaatatgacgtcctggacaacttctcagcctttgtctctagcatctggccacaaatctgtgaaaactgctatggaaatggatagagaagaagaaaattgtcagtcccacagactagcgctttagatgctctcgtgtgcaagcctgtggttttgttcttggggaaagccattcaagtatttctgagtatgatacggcagatcccacctttggaaactagtgagactaaagatgtcattatctggccgggcatggtggctcatgcttgtaatcccggcactttgggaggctaaggcaggcgaatcacttgaggtcaggattcaccttatctcgtatttcatatttacaaatttcatgagtacaggttttctgttcattttgttttcctgtgtctttaagctcaagcattagaaaacaatatagcaagactgatttctttgagtaaggttattacagaacaagcatttgaataataaagaattttttttttttaacagggtctagctctgtcacccaggctggagtgcagtgtcacaatctctgctcactgcaatctctgcctcccaggttcaagtgaatctggtgtctcagcctcctaagcagcccaaggtgggtggaccacctgaggtcaggagttagagaccagcactggccaacatggtgaaaccccgtctctactaaaaatatgttagctgggcattgtggtgcatgcctgtaatcccagctactcaggaggctgaggcaggagagtcacttgaacccaggaggcggaggttgcagtgagccaggaccacaccactgcactccagcctggggtcagagaaggctccatctaaaaaaaaaaaaaaaaaaaaaaaaaaaaaacatataaaatgttcattatatggcaaaatttataagcaaattcaaaagtaagtgattagaagatatttacaatatatttaataaacaaagggttgatatccagaataggcagggtaccgtggctcacacctgtaatcccagcactttggagaccaaggtgggcagatcacttgagcccaggagttcaagaccggtctgggccacatgacgagactccacctctacaaaaaatacagaaattactcgggtgtggcggcacgcacctatagtcccagctactcaggagctgaggtgggagaatcatttgagcccaggaggtcgaggctgtggtgagccatggttgtgccacagcactccagcctgggtgacagagggagaccttgtctcaaaaaaaaacaatcaatcaatcaatcaatcaatccagaatatatgaagaactatataattcagtaagaaaaatacaagagagaaagtttgggtaaagaaagcaatagcaaatggacagaagttaaaacctaggtggccaagaaacacaggaagatgctcaaacttaaatgtattggatgaaaattagaaatattataaatcattcttttaatctatcaagttggccaaaaataaaaaatctcatactatgatgtgttggcaaggatgtggagaaaggaaaacacattttttttctcgtgcaagtatctactggttaatctttaaggaaaattttagcagtgcttacgaaaatggaagctatgaaacaatttaaatttctatctgtagcagaataaaatatattcatctaaaggaaagctaaatagcagttgaaaaaataaattacacctctctctatatactaactgggaccggctcaaaaacagtgttgaatgaaaaaaagccaaatgcagattgtgcactgtgtgacaccaattcatggtaagcataaggaacctaagaatgtgttcaacaaaagctatgcaagacctttttgggaaaaagcataaaagctttctaaaggacaattttaaaaaatctatgagtaaatggagagagagacatatcctgctcaaatctgttaagattcagtttggcctcatgtaataggaaatccaaaatagcagtggtttaaacgagagaatttatttctctcttgtgtaaaaagtccaaaagctggcaaacctctgctttgtacaacactgaatgtttcctaaaggagcagtccccaagctttttggcaccagggactggttttgtggaagacaatttttccatggtgagggtttgggtgggggatggtttcaggatgattcaggtgcattacatttattgtatactttatttctgttattacattttaatatataatgaaataattatacaactcaccatcacgtagaatctgtgggagccctgagcttgttttcttgcaaccaggcatcccatctgggggtgatgggagacaatgacagatcatcaggcattagattctcataaggaacatgcaacctagatccctcgcatatgcagttcacaatagggttcacactcacgtgagaatctaatgctgctgctgatctgacaggaggcagagctcaggtggtagtgtgagtgacggtgagaggctgtgaacagaggaagctttgctcactcacccactgctcacctgctgtgcagccctcctgccaccagtctgtggcccaagggttgaggacccctgtcctagaagactttcctctacttcatctcattcagtccttctaacaacctagtaagataacaagacagatatcatcatcaccattttgcagatgagaaaactggagtttggagaaatctgtaacttgcctgaagtcacagatttgagaccaaacccagtctgattgctccttcagtgtgcgtcaggctgttctggttgcctggaacctcccatgtcctgaagcccaggtgaacactcacaaaattcttttgtttcacataacctgaaggccttcggttaatatgctagaataggacattgggtactaagttaacacaaatataattggttctttggtccttccaaaaatgtatctatctcaagaaaagcaaggactagggaccaaatcattttcctggggcccactacagggctgatattggtgaggtctctcttctaatgtaactaactgcctctatcatttaccacagaaaatgtttttgtccttgtgtgggctggatttcttccaagctgtatttttatcacataatatttatttcaataatttcaataacgactttcagtaatttaggatgaaatcgatacatctgctcagtcttttgaggtctaatcaaaatttctgagaaaatttttttcacacttgggactttttctttcaatgccattttttttccataagatgcctccatagctggtgtacctttagaagtatatgtgtgagaacgtaaatggagggtttacacttgcatttttttcaaagctcatacaaagctagacaaagctataatgtgaacatgctaaactctgtaagtaagtagtccccatggtcactaatgagcacataatcactgattctcagaacttgcatatatcagccagaatctgttaacaattagaagctgacagcctgggcaacatggcaagaccccatctctaccaaaaatataaaaaaaaaagctgtgcatggtggtgtatgcctgtggtagcagctactctgaaggctgaggtgagaggatcgcttgagcccagtgaggcggaggctgcagcgagccaaaactgtaccactgcactccagcctgggtgacagtgtgaggccgtctcaacaacaacaaaaaaagttgaacctgcttttctgtgtttactggctgtttggagttcagctgttgatttccttaccccaactttattttgtgttattcttgtggacttgtagctctttagtctggatgttaaccatttgttgattaaatacatagagagtatcttccccttgtcagtttatttttatcttacagattatgtttggaggggcggcaggagggctagagttgcactgttttctgtagaccagtttacttttatggatatatgctttttgtgttctaagaaatatttctctattcaataatatattatttagatatttttatcacttaaaagtttttagtttacttaggatttttgaatactatgaaactgccaagctattaattattctgtgtttattctcgtaggtggtgcggctgaacaagctggaataatagaagctggagatgaaattcttgctattaatgggaaacctctggttgggctcatgcactttgatgcctggaatattatgaagtctgtcccagaaggacctgtgcagttattaattagaaagcataggaattcttcatgaattttaacaagaatcattttctcagttctcttctttctttagcaaatcagagtgacttctttaaaccacaggttgttgaaatggccaacactggtacagacacggactataaaaatctccaagcttgtgcttacacatgaagcctgacttaactgtatgtgcaacagcaatgaaattaactccagaagccttccacctgcgtcacccaggccgggagggttccttcgttccagtgcctgtcccctacctttatgttatgtttactgatggggatacaagatgtgacacacccttctttatttgaaacaaacaaacatttagctagacctttgcttccttcttgccagctctcccaacatacccaatcctggtgatcagggaactaaaagtctgagggggacacaaatgtcacacctaagaggacaatcaatcattttgtatgattttgtaagtaagtaaatgacagaatgcttttaggcacattcaatggaaggaggagatgtaggtctgtatatgttaccctgaaaagagaataagacttacttaaaaaaatgaattatgacctgttaggctgagctcaggaattgtccaaaaaggaaaaagcaaaataattaattgagagtattttttagtgagtgtaatgtataatgtacgtatgcaaagttcaactcaataggttattgatcaccatgaagtattgatcattttctatctcaaaagtgtaagccataaggctgttttacagaatagcacttctgataagctgtattaaatagccatgagcttcactgcttagagggagcagaaaggtcaacatctaaaagcaccttacaactagtttttgaacctgtcttgataagtgcttgaattcaagactggtcagtacaagagcagacaaaaatatcacaagtcagtcactgggtttccatttctgaattttatgcactccaaccatgaatttaaactaaatttttagaaatcaagtatctttctaagtgtccttggatttatagacaatgtatgtacaatccaaatagaggagcttaatggaatccttttaggagactggttggtttttttccctctttcccaacatgtttaagaaatgtaacattctaagtattggatctcttttcttgacctagtataatgacaactgcagtgacttaagtttttgctgttttcgttttcccgctttgcaatttcctccttttgccaaaaatgttttcctacagaagactgtcgtgactcacgctacttgggaaactcactctggccactcctcctctggtggcatgagctgcttcccagtagctattccgattggatattccgttcgtcgtcacatagctggcttttctctcctcatgatgtaccttattttcttaggtaaataattccaaactctcatcgggtcataaagaggaggagaaacagggtgagtcaaggtaaaggagcagaaatgtagttacaagccaggtcgtcttcagtggcacaaaccaacccgttgagccctgacaacatgagtggagagtgcatttgccatacctgtgtgcatgacactaagattttatgttggagatacttctttaaataacctacagcttgggtctatggctgtgacccccagattcatggaggggctttagccatcagctttgtacatcatcatttttctgaatgaccaatcccactaaacatctttgaagtcggcctagagaggtccttcagatgagagagaaatagctggcttgtctgagtccagatttctcatcaactggcaatacaaaggaaaatatggtacaggagttagttagaaaggtcttattgattttacttctacttttcactacagttacaggtagaatactgtaggaagtcagtgcaaggtgcatgcttgattgatagatattgattgtttttcagtctctggggtcagttttgtggtttctgctttcttgcctaaatcaaagactatttcaagtcaacaacactgaaaactgcttttcgcctccactcttacagctgtgcctaataataattaattaataaacgcacagccctatgtgaacagacaggaatttcttgtgcaatgtggagcaaatggaatggtctccttccgcaagtctttttaatcctcatatctggagtacaagggtagacctctggcttaccacatacactatgctaaagtcatcagccactgctactacatcttgccagaaggtttccctcgccaacaaacagttgaaatttaagggaagaagcaaaagctaaactgtctttgaccctaagatagatagaaagctatttatttgtcttcagtgttcaaggcatgactagtatttctaattagcctaataaattcccacactttctgaagtgaacactaatggtattgtcctactaaaactgtcattgtttctttttttttaactggtcagtcattcacaataagctatgagggtaaataaatatgtgttataacaagtaaaccgtagttgcaagaatataccatgaagattaaagtaggctgggtttcatttccatcttcccacacatctcattgaatttgatggttgacttaattggcaccataactttgtatgatattatacattaacctttatttatgtaaagtaaaatgccttatatattaaagagtaagtgcaataatatgaaatagcctgtacattttaaaaatgttgtcaccaagttatataaatccacatctctgtaaacaaccttttttaagtaattttaaaaaaaataaacactctgcttactacttgattttttttttctcttttggctgtttgtttgttaataatagagtaatattgagatgagaaatgtttattgtcacctaaatgcatcagaggtacaaaggcaatagaactcaaattagccacccttttccaggccacactcacaatcttgacacaatccaaaacttttccacctctaaatctttcttac

SEQ ID NO: 13306 - DNA, 1553 bp, Homo sapiens
gaatgaagaagatgtttgcttcatagtcttgaatagaaaagaaggctcaggtctgggattcagtgtggcaggagggacagatgtggagccaaaatcaatcacggtaagtgacagagtcattaggctctcaggaaaatcccccctcaagcagcctcagaatgtgatcagggcacaaattccaatcagcgggttcagagattgctggatttcattcccagctaccaacataaaaagggagaagtgggagaagtagtacgtaaggttttcgttgacaaaagacaagcatttttaacacagagctgacatgtataggccatttccaatccctataaacacaattcgctatagccttataatttacctccatattttaagcagtagaaaacattagaatcaactggccaaacttgtgtttatacaattactcccgtctcaaaaagtcactcaaaattttacatcattcaaaagccttcaggaccatccagagggtcaccttcactgcacgagcccaggcctcattcatcttcgtattcccattgcctcctggatgccaggcccatgtcagacactaaaaaggagttaaaaaaaaatgtgtggagacactggcattgacatttgtgttccatcccccgcactgaatgtatgtttttttttataaagcaagtgtctaccttagaaagttcctttactacaagacccggcacggtggctcacgcctgtaatcccagcactttgggaggtcgaggcgggtggatcacctgaggtcaggagtttgagaccagcatggccaacatggtgaaaccctgtccgtctctcctaacaatacaaaaattaacttggcatagtggtgtgtgcctataatcccagctactcaggaggctgaggcaggagaatcgcttgaacccgggaggctgagattgcaccactgtactccagcctgggtgacacagcgagactccctctcaaaaaataaaaataaaaaaggaaggttcctttactacagatacgcagttagttactatctcccttttaccggaaatcgtaagtggatctggtttttgttcccttttcctttcctcatcccaggtccacagggtgttttctcagggggcggcttctcaggaagggactatgaaccgaggggatttccttctgtcagtcaacggcgcctcactggctggcttagcccacgggaatgtcctgaaggttctgcaccaggcacagctgcacaaagatgccctcgtggtcatcaagaaagggatggatcagcccaggccctctgcccggcaggagcctcccacagccaatgggaagggtttgctgtccagaaagaccatccccctggagcctggcattggtaagatgatcatttcaacaaccagcaggctgtgagctactgcagaaagaggagattctggttgaacatgaaggaaaataacagctaactaacttctagatctgaaaaattaaatgtagcgaagtctagtgtgtttggatgctgcttacaaaagcagtgttacaaataaattagaaaaaaattagaaaattagaaa

SEQ ID NO: 13307 - DNA, 1552 bp, Homo sapiens
gaatgaagaagatgtttgttcatagtcttgaatagaaaagaaggctcaggtctgggattcagtgtggcaggagggacagatgtggagccaaaatcaatcacggtaagtgacagagtcattaggctctcaggaaaatcccccctcaagcagcctcagaatgtgatcagggcacaaattccaatcagcgggttcagagattgctggatttcattcccagctaccaacataaaaagggagaagtgggagaagtagtacgtaaggttttcgttgacaaaagacaagcatttttaacacagagctgacatgtataggccatttccaatccctataaacacaattcgctatagccttataatttacctccatattttaagcagtagaaaacattagaatcaactggccaaacttgtgtttatacaattactcccgtctcaaaaagtcactcaaaattttacatcattcaaaagccttcaggaccatccagagggtcaccttcactgcacgagcccaggcctcattcatcttcgtattcccattgcctcctggatgccaggcccatgtcagacactaaaaaggagttaaaaaaaaatgtgtggagacactggcattgacatttgtgttccatcccccgcactgaatgtatgtttttttttataaagcaagtgtctaccttagaaagttcctttactacaagacccggcacggtggctcacgcctgtaatcccagcactttgggaggtcgaggcgggtggatcacctgaggtcaggagtttgagaccagcatggccaacatggtgaaaccctgtccgtctctcctaacaatacaaaaattaacttggcatagtggtgtgtgcctataatcccagctactcaggaggctgaggcaggagaatcgcttgaacccgggaggctgagattgcaccactgtactccagcctgggtgacacagcgagactccctctcaaaaaataaaaataaaaaaggaaggttcctttactacagatacgcagttagttactatctcccttttaccggaaatcgtaagtggatctggtttttgttcccttttcctttcctcatcccaggtccacagggtgttttctcagggggcggcttctcaggaagggactatgaaccgaggggatttccttctgtcagtcaacggcgcctcactggctggcttagcccacgggaatgtcctgaaggttctgcaccaggcacagctgcacaaagatgccctcgtggtcatcaagaaagggatggatcagcccaggccctctgcccggcaggagcctcccacagccaatgggaagggtttgctgtccagaaagaccatccccctggagcctggcattggtaagatgatcatttcaacaaccagcaggctgtgagctactgcagaaagaggagattctggttgaacatgaaggaaaataacagctaactaacttctagatctgaaaaattaaatgtagcgaagtctagtgtgtttggatgctgcttacaaaagcagtgttacaaataaattagaaaaaaattagaaaattagaaa

SEQ ID NO: 13308 - DNA, 401 bp, Homo sapiens
ttgggaaacagcaaggttgtattctttcctggtttagaagaaaagaaggaaatgagggggcaagagtattttgtgtctgaaaacagaaattgcagccttagtcaaccaagaagaactcactggaagaggtttagaaacagattttctacgttccgtccatattcagagcctcagaaccacgtgcagcgtctgtttctgcagtgcgagctgtttaatgccctgttaagtactgcagatgtctggagtgccgtgcatcttggcattcagggagtgacgtctttttttattcgagagggcaaagcagagggtatgggttaggcagtgccttctgggaggggccttttgttccttctccacatctctccctgataagggtagctggattcctttctacaacttgg

SEQ ID NO: 13309 - DNA, 590 bp, Homo sapiens
tggaattttggtaggaattgtaccgaatctatagatgactttgggtagtatggacattttaacggtactcttccattgtcttccttaccttcctcctcctcactctctggccaaactccccttgtcagccccattcatgtccccacctcctctgtcaagtcttcctgggataatctggcttctcactctcccactcctctgaattcgtcaagacagccagagctcggtgtagacctgtatcccagctttcgtattctgtatgttttccctagttagcctcagcccctgcactaaaaaggaagcctcttgagctcggcacttggactgttttacactgaagtacatcattcacatcccccagtgtgagccaaacccacacaccactggccagatactgggactgagaggtccatgagggccctgctgcatccacgcaggagtagggaaccaaatagaacaagagcctgacgcttgcggctttgccatcagagggtgaatggcataaagagacccaagtgtgcaatgattaaatcagggtaatcagcatatccatcacatcaaatgtatcatttctttgtggtaggaacatc

SEQ ID NO: 13310 - DNA, 270 bp, Homo sapiens
tttgggaggctgagacaggcggatcacgaggtcaggagattgagaccaccctggctaacacggtgaaaccccgtctctactaaaaatacaaaaaaaaaaaaaaaaaaaaaaattagccgggcgtcatggcgggcacctgtagtcccagctacttgggaggctgaggcaggagaatggcgtgaaccctggaggcggagcttgcagtgagcagagatcgtgccactgcactccagcctaggcgacacagcgagactccatctcaaaaaaaaa

SEQ ID NO: 13311 - DNA, 547 bp, Homo sapiens
tttttttttttcttttcttgagatggagtctcgctctgttgcccaggctggagtgcagtggcgtgatctcggctcactgcaagctccacctcctgggttcacgccattctcctgcctcagcctcccgagtagctgggactactggtgcctgccaccatgcccggctttttttttttttttttttcagtagagacggggtttcaccgtgttagccaggatgggctccatctcctgaccatgtgaaccacctgcctccgcctcccaaagtgctgggattacaggcgtgagccaccgcacccggcgtaggaggcctcattttcaaatattgtctctttgctcccataagacattgaaatatctgagaagtgttcctattttcagcaccacattacctcctagaagctggacaaagaccatttactgggtcccgtattcccattttgtttggaaagcttagtcaacctctttctccccatcaatccgtgtgtgagcatacatatggttgaaggtgcccatgaagtcaacctcccaactcccccaaaagttc

SEQ ID NO: 13312 - DNA, 400 bp, Homo sapiens
ttgggaaacagcaaggttgtattctttcctggtttagaagaaaagaaggaaatgagggggcaagagtattttgtgtctgaaaacagaaattgcagccttagtcaaccaagaagaactcactggaagaggtttagaaacagattttctacgttccgtccatattcagagcctcagaaccacgtgcagcgtctgtttctgcagtgcgagctgtttaatgccctgttaagtactgcagatgtctggagtgccgtgcatcttggcattcaggggtgacgtctttttttattcgagagggcaaagcagagggtatgggttaggcagtgccttctgggaggggccttttgttccttctccacatctctccctgataagggtagctggattcctttctacaacttgg

SEQ ID NO: 13313 - DNA, 400 bp, Homo sapiens; identical to SEQ ID NO: 13312

SEQ ID NO: 13314 - DNA, 1435 bp, Homo sapiens
ctccatgtcatctgccagaaaggccacctgcgccagcacctcctgagaccggccttcaaagacacgacgcatgccgctctgccgtccggagcacttaatgcctagagccagcagggtcccagtggccgcgtcactgcctctgagccacgcggtcattccaactcaactgccctcgcgtcctggccacaggccccctgggagaccccggagatgcccaaaggcctcatgcctgccgcctccagtgggacctagcagcacacagacagcgaagcgggtgaccatggggtggccacggccgggccgagccctcgtggcagtcaaagccttgctggtcttgtcgctgctccaggtgcccgcgcaggcagtggtacgggccgtgctggaagacaactcgagctcggtggactttgcggatctgccggcgctgttcggcgtccccctggcccccgagggcatacggggctacctgatggaggtcaagccagccaacgcgtgccatcccatcgaggccccgcgactgggcaaccgctctctgggcgccatcgtgctgatccgccgctacgactgcaccttcgacctcaaggtgctgaacgcccagcgcgccggcttcgaggcggccatcgtgcacaacgtccactccgacgacctcgtgagcatgacccacgtctacgaggacttgaggggccagatcgccatcccctcagtgttcgtgagcgaggccgcctcgcaggacctgcgggtcatcctgggctgcaacaagtcggcccacgcgctgctcctgcccgacgacccaccgtgccacgacctgggctgtcaccccgtgctgaccgtgtcctgggtgctgggctgtaccctggccctggtcgtatcagccttctttgtcctgaaccacctgtggctctgggcccaggcctgctgcagccacagacggccggtgaagacgtctacctgccagaaggcccaggtccgcaccttcacgtggcacaacgacctgtgtgccatctgcctggatgagtatgaggagggcgaccaactcaagatcctgccctgctcccacacctaccactgcaaatgcattgacccctggttctcccaagccccccggcgctcctgccccgtgtgcaaacagtcggtggccgccacagaagacagctttgactccaccacctacagcttcagggacgaggacccctccctaccgggccaccggccccccatctgggccattcaagtccagctacgctcccggaggctggagctgctgggccgcgccagtccccactgccactgcagcaccacgtccctggaggcagagtataccactgtctcctcagcccctcctgaggcccctggtcagtaaagatctagggcagggaggggggtgcaatgaggaatgtttctggtctgaaaagaataaagtgggtttgaaagcgga

SEQ ID NO: 13315 - DNA, 7591 bp, Homo sapiens
gggaattctgcttctccctccactacctgggtaaccctgggcaagtcacttagcctctccgagcataaactggtttgcttgtaatatgcaaataataaggggtgggggaaattttttttttttttttttgagacagagtctcgctctgtcacccaggctggagtgcagtggcgtgatctcggctcattgcaacctccgcctcctgggttcaagcaattctcctgcctcagcctcctgagtagctgggattacaggcgcccgccaccactcccagctaatttttgtatttttagtagggacgaggtttcaccatgttggtcaggctggtctcaaactcctgacctcgtgatctgccctccttggccttccaaagtgctgggattacaggcgtgatggagatgatactccctaaatcacaagggtgtggtgtgaagatgaaatggctgcacgtgacagaggagttggagaacaggaagcaagtggattacttggatgaactgtgatgggcccaagaagaactaagccaatcactccagggggcgttttcccaggatccaggcagagagctgattccagcatccacgttgtatccccctcccgctgtggccggggtctccaagagccgggcacccactgcagagcttccaagcccaggcccatttgaacacaggaggacttttgaggttcatttaaccccaaaatcagtgattctacatctcaagctcatattttgaagtgtttacgggtaagtcatatgatactggtcatttattttttaaatattctagccaaaagtacatggtagacaaagtgagaatgtcagaatgttgataattagtgaaactagacgaagatacatgaaagtttaattttgattctcacctactttcatgtgcattaggaaactttcataataagttaaagtaacaaaataggccagactcggctgctcatgcctgcaatcccagcactttgggcggctaaggcaggcggattacttgaggtcacgagtttgaaaccagcctggccaacgtggtgaaaccccatctcccctagaaaataaaacaaaaaaaaaaaattgtagctgggcatggtggcaggcccctgtaatcccacctactcaggagggtgagggaggagaatcgcttgagcctcagaggcagaggttgcagtgagccaagattgcgccattgcactccagcctgggtgagagagcgagactccatctctgaataaataaagtaacaaaatacatttcagtctcgagctccagttccctgccaggaagagctgaagctgagctctggcaccccctgcttcttctccctcatccctaaaacatgtggggtactgggtgccaaaggagatctgaagatggccaccactcagaccagcagtagaggccaagaaggtggtgagaaattttaaggtattgtagcatatgctctccagggtgaggacacaggatgctgggacctaaggagggagaagttaacccagagagggcccaagtcagggaggacctgactgtggtgacagagccagtcatgctaataataggagcagtggttttgcaatcacaaatattggtctgggggactgcgggcccaatgtggtgggagttttagagcagggacccctccactgtacgtggattcttatacttgctaagttgcactgaattctcaatcaacccatttggaggctctcaccaagacaggagtccctttgaattggtaggatgttaaaagcttcctccagccattgaccctgggtcccattggtagaaatcagataataaatcagattttccaggtaatcctcagtttaatgtccattccctcattcaatcaattattcaattacaaatcatttttaatatgattttatggttcaggaattcaggcagggctcagatgggcagttcttctgccccacatggcattggctgataacaggctaccccaaggaaatcacagtgtaatgggagatgggaaataggttaacacaaagttactatactacaagaaaaatcttcaaatcttcaatcttcattcttcatgggtgtgagtcttctctggtggagaagagagttctttgctaaattatattcctgtgttagccagccaagcacacacggagtacagctgtcccttgctattcatggcagattgatcccagacactgccacccccagccctgtgaacaccaaaacccatggatgctcaagtccttgatataaaatggtatggtatttgcacataacctacacacatcttcccatatactttaaatcatcactagattacttataatacctaatgcaatgtaaatgctatgtaagtagttgctacgctgtattgcttagggaataatgacaagaaaaaaaggctgtacaacttcagtacaaatgctatcattcatttttttatctgaatattatgatccatgaatacagagggctggctgtaaaaagaatgtacagtttggtactttactcctagtttaagtcatctctttcggcccatacaggttgcctggggcagggcggtggtgagtgtgttgagtcggccctataccctgttccacaatgcctggtgtccttggcacgtagcttgcagggctgcttccatggatggctgcctcatcccccacccctccttcatggcaccctcttttctccaactccttttcctctgctgagtcctaccttttcttgccagaccagggatttgccaattattctggatgggcacagggaaggggccctcagatcctgcagagggagcatctgaaagacaatgagaccctgtacacaaccaagctgagcctcctgtaagcacatcctctgggtgtcactatgcgaaaagactctttgtctgtttacattgcacaacgaattgtccctctgattgtcctagcgttggtgcatgcatggatccaggaagagcaggtatttggacccaacgagacaggttcatcttggcagtttgtctcctgtggttgctttgtgcctgccccgtatctatccacccaacttctggcagcaatccctccaggacccacctctgtcttcatggtttgtgtgttctgatcctgctccttggccccagaatacaccctccacatctaagctatgcagtgcctcatccccacagctgcagcgattggtttaggaatgggaaaataatccaatcaaagtaagattgtctaatatctgatcccgcttaccccggagccagaagtcccacctttccaggctcctccatgttcctttctggagcaatgaggaggaaggttcattcccttctcagggaacttgctgcggtgtcccagtcctgactgtcccctctctacccctgcctgtggctctcccgtctcctggcattctaacctgccactgaattcttcccacgccaaacgcaggttaggaacctaagctcggatgaaatgctggcttagacctcattgctactgagaagcagaaaccacactttttagttggtagaggtggatgtggattggggccataaagtttcctcaatcattgaataaggatttcattatttggactaactaaatacattagattatttatactaactaaataaattagatttatttttcgaagtttaaaatcattttcaatagtgacgaaaaaggctgtagatgagatgggagaatctttcgacgccaaattcttcccatctcctgcctagtatgtatcactacaccttgcccagagagactgtaggggtgctcagcaaaaaccatggctggttgattccctggaaaaaggggtgctgtcccagggagctctgtgcccttcctgccaacactggggtctagaggaggcaagttcccctctgaaggtgagtatgattcactcattaaaactaagaaatttacattggtatgttactgttaactaacctacagactttttttagatttcaccgttctttacactctcgtcctttccaatttccgggatccaatgcaggataccaggttgcatttttggatgtgtccagtctgtgatcatttctcaatctttcctcattttctcatgacttttgacatttatttatttatttattgtgtgagactgagtctcactctgttgcctaggctggagtgcagtggccccatcctggctcactacaatctccacctcccgggttcaaatgattctcctgcctcagcctcccaagcagctgggattacaggcgcacaccaccacgcctggctaatttgtatttttagtagagatggggtttcaccatgttagccaggctggtctcaaactcctgacttcaggtgatctgcctgcctcggcctcccaaagtgctaggattacaggcgcaggccaccacgcccagcctgacttctgacattagagtacagggagggattctgtagaatgtccctcaatttgggtgtgtctggtgttttgccatgagactggggttatgcttctgggtgccacacagaggtgaaatgtccttctcatcacattattcgagaggtacatggtaccaatgggacttatcgctgctgatgttaaccttgatctcttggttcaggtggtgcctgccagctgtctccactgtggagttactatttttccttttccccattttattcatcagaagccagtcactaagcgaggtcaaactccaggacaggggaattaagtgccaccttctggagagggagcattcacatttattacttgggatccttctgtaaggaagagctgtttctcctctaaaaaactctttaatccttttaagcctcaatttcttaattgtgaaatggggctaatacctgtatccaaccaagggagtagttagaaggtaacatgataggtggaaagcacttaacataggcaaaatgttatgatcaggaatgatcgagagacccatccaactatctgaaggagtcacttaactctactgtactgcagcgctgtaaagtctgcatctttcactgggggtaaaggcccccagtccctgagacgggccagtttggagacaggctggttttttctctgttctcctgagagcccttcagatgagaagggaggtctggagacagaatgccaaaagcccattaaaggcacggccttgcatttcagagagggagcaggtctagagaagaaccagaggagctcagctgagatatggtgtatggattggattttggtagaagatgggaagaaccaaacacctgagaaaccactttgaagatcggggtcagagtaaggcctaacacatagttggctcccagtaattattggttgattgaacagctcaaagagcaactcgaccaagaacactggactgggagtccagttacttggatcttgcattcctgatttatttttattttatatgtattttttctatttttttgagacgaagtctcactcactctgtcgcccaggctggactacaatggcacgatctcggctcactgcaaactctgcctcccaggttcaagcgattctcctgcctcagcctctcgagtagctaggattacaggcatgcaccaccacgctggctaatttttgtatttttaggagagacggggttttgccatgttggccatgctggtgtccacctcctgacctcagttgatcttcctgcctcagccttccaaaatgttgggattacaggcgtgagccaccgtgcctggccgtgatttattttttttgtgtatgtttgtttttgtcaacttgctgtgtgaccttaagcaagttacttaacttctctgggcttcactttccatggatgaacattgtaaagaggctggagagagatgaggactaggtacaggctttagaggagagccaccgccccggacttctccctctgtcaccccgctttccatgaccctccttgcctgactttgtgactccttgcctcgctatcaaaacaagtgctgcaatctcagtgctttccaagagccctgcattgttagaaacttcccagcacgcagcaaaggctgctgcaatactcgctctgcctgcctttgccctgcgcttcctacttaccctccttttgtttctcccaaacatctgtccctgactatgctcatctcatgtttgtcctcagctgctgaaagggccacgtttgctttcattacaaataagaccaccgagtgggctcctggcgtgggggcgggagcagccgcgcgcagtcttcagaggcagccccccaggctgtctctggagggtgtgtctctgcttccctttccccgtgtttattttcagacgaagccaagtggcccggggggaccctccggactcccagccttcagagaggagggcagctcgggctttcgccgcagtgcttcctgcccgtcacgtgtgtgctcctagccggggtcgggggagctggtatcttggcccttctgggaggacgcgcacagcccgaggaggcagagccccagacgggaatgggcttttcagaggtggggtgcgggcgaggggacgatgcattatttttaatatttgatttatttttccaactggacttcttcccggggctctttctgggcccagctgcctttgtgatcccgcgccccggtcctcggcctctcacctccagcgccggggcgccccctgctgtcggaagcggctgtgaccgggcagaggtgctatctgggactctgggttctcagcccggggacagcgaaccgaggggcagatgatccatcagaaaagagccggcactgcccagccccgcgcccctgcccctgcctttttccgggagcgcgccgcgccgcacccgctacggccgcttgaccccatctttgagcccggccccaagctctgggaccgtcgtgcccctcatcaaggaagagccaaggaccccaaggagaaggtcaggagcggcggtgtggatgtcccttggctgcaggccccgccgcgcactcccttcagtccttcccttctctagggaccaggtagcatcagtgcctggatctcggccttgtgtgccctgctccctgccccacctactaagaaccaagtctggttcaccggctcccaagagctggaacccattctcagctagctgggggcccaggccaccccttccctccagacctgtgtgccttctgccctggctccagggccccccacaccgtgaccagggcgggatccctatggggctggccagtcggcaccgtgccaggcccacagtgccctgggcgtccatggaagtcgttctgtgtctttaaaatcagaaggaagacattaacctttaggctgaagaaaatgttttagtacacagcaataacttatttgtctttatccaacagccataaaatataactttaaatattctattgatagagaaaggagttcatgaaggcagaaatgcctggggcccacgaacatcccagtgtggccctggacgggacatcatgctgggcaacacagctaaaatgcgggtgaagaccagatttcttgcacatggcggtgacgggatgctccctagagagcttcaagtggattctttgctttttattttctctcttaataaaaatgtatgatgtttacattgtcagagaacaaacagaa

SEQ ID NO: 13316 - DNA, 7557 bp, Homo sapiens
gggaatactgcttctccctccactacctgggtaaccctgggcaagtcacttagcctctccaagcataaactggtttgcttgtaatatgcaaattataaggggtgggggaaatttttttttttttttttgagacagagtctcgctctgtcacccaggctggagtgcagtggcgtgatctcggctcattgcaacctccgcctcctgggttcaagcaattctcctgcctcagcctcctgagtagctgggattacaggcgcccgccaccactcccagctaatttttgtatttttagtagggacgaggtttcaccatgttggtcaggctggtctcaaactcctgacctcgtgatctgccctccttggccttccaaagtgctgggattacaggcgtgatggagatgatactccctaaatcacaagggtgtggtgtgaagatgaaatggctgcacgtgacagaggagttggagaacaggaagcaagtggattacttggatgaactgtgatgggcccaagaagaactaagccaatcactccagagggcgttttcccaggatccaggcagagagctgattccagcatccacgttgtatccccctcccgctgtggccggggtctccaagagccgggcacccactgcagagcttccaagcccaggcccatttgaacacaggaggacttttgaggttcatttaaccccaaaatcagtgattctacatctcaagctcatattttgaagtgtttacgggtaagtcatatgatactggtcatttattttttaaatattctagccaaaagtacatggtagacaaagtgagaatgtcagaatgttgataattagtgaaactagacgaagatacatgaaagtttaattttgattctcacctactttcatgtgcattaggaaactttcataataagttaaagtaacaaaataggccagactcggctgctcatgcctgcaatcccagcactttgggcggctaaggcaggcggattacttgaggtcacgagtttgaaaccagcctggccaacgtggtgaaaccccatctcccctagaaaataaaacaaaaaaaaaaattgtagctgggcatggtggcaggcccctgtaatcccacctactcaggagggtgagggaggagaatcgcttgagcctcagaggcagaggttgcagtgagccaagattgcgccattgcactccagcctgggtgagagagcgagactccatctctgaataaataaagtaacaaaatacatttcagtctcgagctccagttccctgccaggaagagctgaagctgagctctggcaccccctgcttcttctccctcatccctaaaacatgtggggtactgggtgccaaaggagatctgaagatggccaccactcagaccagcagtagaggccaagaaggtggtgagaaattttaaggtattgtagcatatgctctccagggtgaggacacaggatgctgggacctaaggagggagaagttaacccagagagggcccaagtcagggaggacctgactgtggtgacagagccagtcatgctaataataggagcagtggttttgcaatcacaaatattggtctgggggactgcgggcccaatgtggtgggagttttagagcagggacccctccactgtacgtggattcttatacttgctaagttgcactgaattctcaatcaacccatttggaggctctcaccaagacaggagtccctttgaattggtaggatgttaaaagcttcctccagccattgaccctgggtcccattggtagaaatcagataataaatcagattttccaggtaatcctcagtttaatgtccattccctcattcaatcaattattcaattacaaatcatttttaatatgattttatggttcaggaattcaggcagggctcagatgggcagttcttctgccccacatggcattggctgataacaggctaccccaaggaaatcacagtgtaatgggagatgggaaataggttaacacaaagttactatactacaagaaaatcttcaaatcttcaatcttcattcttcatgggtgtgagtcttctctggtggagaagagagttctttgctaaattatattcctgtgttagccagccaagcacacacggagtacagctgtcccttgctattcatggcagattgatcccagacactgccacccccagccctgtgaacaccaaaacccatggatgctcaagtccttgatataaaatggtatggtatttgcacataacctacacacatcttcccatatactttaaatcatcactagattacttataatacctaatgcaatgtaaatgctatgtaagtagttgctacgctgtattgcttagggaataatgacaagaaaaaaaggctgtacaacttcagtacaaatgctatcattcatttttttatctgaatattatgatccatgaatacagagggctggctgtaaaaagaatgtacagtttggtactttactcctagtttaagtcatctctttcggcccatacaggttgcctggggcagggcggtggtgagtgtgttgagtcggccctataccctgttccacaatgcctggtgtccttggcacgtagcttgcagggctgcttccatggatggctgcctcatcccccaaccctccttcatggcaccctcttttctccaactccttttcctctgctgagtcctaccttttcttgccagaccagggatttgccaattattctggatgggcacagggaaggggccctcagatcctgcagagggagcatctgaaagacaatgagaccctgtacacaaccaagctgagcctcctgtaagcacatcctctgggtgtcactatgcgaaaagactctttgtctgtttacattgcacaacgaattgtccctctgattgtcctagcgttggtgcatgcatggatccaggaagagcaggtatttggacccaacgagacaggttcatcttggcagtttgtctcctgtggttgctttgtgcctgccccgtatctatccacccaacttctggcagcaatccctccaggacccacctctgtcttcatggtttgtgtgttctgatcctgctccttggccccagaatacaccctccacatctaagctatgcagtgcctcatccccacagctgcagcgattggtttaggaatgggaaaataatccaatcaaagtaagattgtctaatatctgatcccgcttaccccggagccagaagtcccacctttccaggctcctccatgttcctttctggagcaatgaggaggaaggttcattcccttctcagggaacttgctgcggtgtcccagtcctgactgtcccctctctacccctgcctgtggctctcccgtctcctggcattctaacctgccactgaattcttcccacgccaaacgcaggttaggaacctaagctcggatgaaatgctggcttagacctcattgctactgagaagcagaaaccacactttttagttggtagaggtggatgtggattggggccataaagtttcctcaatcattgaataaggatttcattatttggactaactaaatacattagattatttatactaactaaataaattagatttatttttcgaagtttaaaatcattttcaatagtgacgaaaaaggctgtagatgagatgggagaatctttcgacgccaaattcttcccatctcctgcctagtatgtatcactacaccttgcccagagagactgtaggggtgctcagcaaaaaccatggctggttgattccctggaaaaaggggtgctgtcccagggagctctgtgcccttcctgccaacactggggtctagaggaggcaagttcccctctgaaggtgagtatgattcactcattaaaactaagaaatttacattggtatgttactgttaactaacctacagactttttttagatttcaccgttctttacactctcgtcctttccaatttccgggatccaatgcaggataccaggttgcatttttggatgtgtccagtctgtgatcatttctcaatctttcctcattttctcatgacttttgacatttatttatttatttattgtgtgagactgagtctcactctgttgcctaggctggagtgcagtggccccatcctggctcactacaatctccacctcccgggttcaaatgattctcctgcctcagcctcccaagcagctgggattacaggcgcacaccaccacgcctggctaatttgtatttttagtagagatggggtttcaccatgttagccaggctggtctcaaactcctgacttcaggtgatctgcctgcctcggcctcccaaagtgctaggattacaggcgcaggccaccacgcccagcctgacttctgacattagagtacagggagggattctgtagaatgtccctcaatttgggtgtgtctggtgttttgccatgagactggggttatgcttctgggtgccacacagaggtgaaatgtccttctcatcacattattcgagaggtacatggtaccaatgggacttatcgctgctgatgttaaccttgatctcttggttcaggtggtgcctgccagctgtctccactgtggagttactatttttccttttccccattttattcatcagaagccagtcactaagcgaggtcaaactccaggacaggggaattaagtgccaccttctggagagggagcattcacatttattacttgggatccttctgtaaggaagagctgtttctcctctaaaaaactctttaatccttttaagcctcaatttcttaattgtgaaatggggctaatacctgtatccaaccaagggagtagttagaaggtaacatgataggtggaaagcacttaacataggcaaaatgttattatcaggaatgatcgagagacccatccaactatctgaaggagtcacttaactctactgtactgcagcgctgtaaagtctgcatctttcactgggggtaaaggcccccagtccctgagacgggccagtttggagacaggctggttttttctctgttctcctgagagcccttcagatgagaagggaggtctggagacagaatgccaaaagcccattaaaggcacggccttgcatttcagagagggagcaggtctagagaagaaccagaggagctcagctgagatatggtgtatggattggattttggtagaagatgggaagaaccaaacacctgagaaaccactttgaagatcggggtcagagtaaggcctaacacatagttggctcccagtaattattggttgattgaacagctcaaagagcaactcgaccaagaacactggactgggagtccagttacttggatcttgcattcctgatttatttttattttatatgtattttttctatttttttgagacgaagtctcactcactctgtcgcccaggctggactacaatggcacgatctcggctcactgcaaactctgcctcccaggttcaagcgattctcctgcctcagcctctcgagtagctaggattacaggcatgcaccaccacgctggctaatttttgtatttttagtagagacggggttttgccatggtggccatgctggtgtccacctcctgacctcagttgatcttcctgcctcagccttccaaaatgttgggattacaggcgtgagccaccgtgcctggccgtgatttattttttttgtgtatgtttgtttttgtcaacttgctgtgtgaccttaagcaagttacttaacttctctgggcttcactttccatggatgaacattgtaaagaggctggagagagatgaggactaggtacaggctttagaggagagccaccgccccggacttctccctctgtcaccccgctttccatgaccctccttgcctgactttgtgactccttgcctcgctatcaaaacaagtgctgcaatctcagtgctttccaagagccctgcattgttagaaacttcccagcacgcagcaaaggctgctgcaatactcgctctgcctgcctttgccctgcgcttcctacttaccctccttttgtttctcccaaacatctgtccctgactatgctcatctcatgtttgtcctcagctgctgaaagggccacgtttgttttcattacaaataagaccaccgagtgggctcctggcgtgggggcgggaccagccgcgcgcagtcttcagaggcagccccccaggctgtctctggagggtgtgtctctgcttccctttccccgtgtttattttcagacgaagccaagtggcccggggggaccctccggactcccagccttcagagaggagggcagctcgggctttcgccgcagtgcttcctgcccgtcacgtgtgtgctcctagccggggtcgggggagctggtatcttggcccttctgggaggacgcgcacagcccgaggaggcagagccccagacgggaatgggcttttcagaggtggggtgcgggcgaggggacgatgcattatttttaatatttgatttatttttccaactggacttcttcccggggctctttctgggcccagctgcctttgtgatcccgcgccccggtcctcggcctctcacctccagcgccggggcgccccctgctgtcggaagcggctgtgaccgggcagaggtgctatctgggactctgggttctcagcccggggacagcgaaccgaggggcagatgatccatcagaaaagagccggcactgcccagccccgcgcccctgcccctgcctttttccgggagcgcgccgcgccgcacccgctacggccgcttgaccccatctttgagcccggccccaagctctgggaccgtcgtgcccctcatcaaggaagagccaaggaccccaaggagaaggtcaggagcggcggtgtggatgtcccttggctgcaggccccgccgcgcactcccttcagtccttcccttctctagggaccaggtagcatcagtgcctggatctcggccttgtgtgccctgctccctgccccacctactaagaaccaagtctggttcaccggctcccaagagctggaacccattctcagctagctgggggcccaggccaccccttccctccagacctgtgtgccttctgccctggctccagggccccccacaccgtgaccagggcgggatccctatggggctggccaggcggcaccgtgccaggcccacagtgccctgggcgtccatggaagtcgttctgtgtctttaaaatcagaaggaagacattaacctttaggctgaagaaaatgttttagtacacagcaataacttatttgtctttatccaacagccataaaatataactttaaatattctattgatagagaaaggagttcatgaaggcagaaatgcctggggcccacgaacatcccagtgtggccctggacgggacatcatgctgggcaacacagctaaaatgcgggtgaagaccagatttcttgcacatggcggtgacgggatgctccctagagagcttcaagtggattctttgctttttattttctctcttaataaaaatgta

SEQ ID NO: 13317 - DNA, 154 bp, Homo sapiens
ggcatggtggtgcctgcctgtaatcccagctactcaggaggctgaggcaggagaatcgcttgaacccaggaggcggaggttgcagtgagctgagatcatgccgctgcactccagcctgggcaacagagcaagactccgtctaaaaaaaaaaaaa

SEQ ID NO: 13318 - DNA, 512 bp, Homo sapiens
agcctcccgagtagctgggattacaggcgtgcgccaccacccctggctaattttttgtatttttaggagagacggcgtttcaccatgttggccacgctggtcttgaactcctgacctcaagtgatccacccgcctcggcctcccaaagttcggagattacaggtgtgagccaccacgcccagccgtctccaaatacaatcacattgtgcattactacagttaggatttcaacatgtgaatttgagggggactcaaatcagtccatacacccaccaccacctccacttccattcacagaaatgattgccagaactacagaccttgagcttgtgtggggtgacaatccgacaagcaacagtgagacagagctgagagggctgcagaccaggatggtgggaccgaggttgctaacaaagcgctgctgagacctgcacagcatggaggtgctgctgggggagaggggtccccgtgagtggatctgcttggtctgcccttgcaaatagttcttgtca

SEQ ID NO: 13319 - DNA, 154 bp, Homo sapiens; identical to SEQ ID NO: 13317

SEQ ID NO: 13320 - DNA, 1963 bp, Homo sapiens
cacccccagaagttctgattcagtgggtggcgggtgaggcctgggaacttcatgacgagccccctggcaaggctgctgctgccattttggtgccacactttgggtactatggctttgggcactcccaatccaggtgccatggcatggggagcagtgggtgaaccaaatcctggagcctggactgttccattgggtgcatttctggctggcagatagaggaccacccagctgtgcttgatggggtctagaagcattgaaactggtttgccgttatgatgtccatgaggttggagtcctttcttagttaaaaaatctgaagacccaacaacacacagcacccccacgctgaaccctcccgagaatgattgagctcttccaaataaagggcgattttgtagcttttcaagttttaacagtttgataactcccaggctcctgttgagatgctttgtgatgaggttgtgcgttcccctgtatctttcctgtgggtgtttatgtgtacagaacacatgtatctgtatttacgtgactgagcacaggcgatttccccgagtctcaccttggtgtgtgccagtgcatgcgcgtgcgcgcgcgcacacacacacacacacacacatacctcctctcagagaatgttgatgtggcaattcatgtttgacagctgggttaacccataaatagatcccaaaatataaatttacccagacctcaacctgcttaagcctttaaatagctcactagggcttttagaatgaagttgaaattccttggcctcacccttaagcctttttagaaggagtcatggaggaagtaaagaaatggaaatggagttgcctcgctgggctcccaggccctttgccgtggccctgcctgctctccagcctggtctcaccccacctgtggcaccttcgctgtggaggataccgtcagccaggctcacagttcctggcaggccacttcctctgtctggggccctgcctgggggtttggatcacctgagtcctgccccttggcaagcctcttttaacccacctgatgccttcacaacccagctcaggagtcctgcttccccaaggccattccgatggctcctgctggcgattccagggcctgccacctggtggcctgtgcactttgctgtgacgtgggctgcacgtctctccccagcatgggctcaaggtgctcaggaaccaaaccccggtgtctcatccaggactggacacgtggtgagagctccatggagcttaactgcatgagggaggcgggatggactctggcttgtagggcacagtctgtgtagcaacaaggaacatacctggtgtttagatcagatgttcaatgactcatgtcccagagaaggggcctgcagccgtattggtcagttggggagcttgtatactcaggccattgaggttgccatggccaccattttgggaatcttttctttgggagttgccatcagaatttagggcattaaaaaagtccttaaatttaggtaatgtttgccttaagcagatggtctttgccttttagaactgtcagaacttgtttacccttcaagctgggcactgtggtaagttgactctttgggtccttggttggaaacatgagaatcccattctggctgactcaagcagacatggattttattcgaaggatgtgggggtggctttgagcatagaggcgttgggatggactgaaccatgggcccaggggacaggcacaggctgcctgtgtatttagggcactgcttgggttgcctggagagtggtttattggcccagattctgccacttcttggccaggggaggcctttcatggacagcctcatcagagtggcagcagagagaagagcagggcaggtcctcaaaggaacactgaaaaggttctctgaaagacaggggcgtagatactgagctggcaataacagcgctgatccactggaatggggaagggcctcgag

SEQ ID NO: 13321 - DNA, 3753 bp, Homo sapiens
cacccccagaagttctgattcagtgggtggcgggtgaggcctgggaacttcatgacgagccccctggcaaggctgctgctgccattttggtgccacactttgggtactatggctttgggcactcccaatccaggtgccatggcatggggagcagtgggtgaaccaaatcctggagcctggactgttccattgggtgcatttctggctggcagatagaggaccacccagctgtgcttgatggggtctagaagcattgaaactggtttgccgttatgatgtccatgaggttggagtcctttcttagttaaaaaatctgaagacccaacaacacacagcacccccacgctgaaccctcccgagaatgattgagctcttccaaataaagggcgattttgtagcttttcaagttttaacagtttgataactcccaggctcctgttgagatgctttgtgatgaggttgtgcgttcccctgtatctttcctgtgggtgtttatgtgtacagaacacatgtatctgtatttacgtgactgagcacaggcgatttccccgagtctcaccttggtgtgtgccagtgcatgcgcgtgcgcgcgcgcacacacacacacacacacacatacctcctctcagagaatgttgatgtggcaattcatgtttgacagctgggttaacccataaatagatcccaaaatataaatttacccagacctcaacctgcttaagcctttaaatagctcactagggcttttagaatgaagttgaaattccttggcctcacccttaagcctttttagaaggagtcatggaggaagtaaagaaatggaaatggagttgcctcgctgggctcccaggccctttgccgtggccctgcctgctctccagcctggtctcaccccacctgtggcaccttcgctgtggaggataccgtcagccaggctcacagttcctggcaggccacttcctctgtctggggccctgctgggggtttggatcacctgagtcctgcccttggcaagcctcttttaaccacctgatgccttcacaaccagctcaggagtcctgcttccccaaggccattccgatgggctcctgctggcgattccagggcctgccacctggtggcctgtgcactttgctgtgacgtggcttgcacgtctctccccagcatgggctcaaggtgctcaggaaccaaaccccggtgtctcatccaggactggacacgtggtgagagctccatggagcttaactgcatgagggaggcgggatggactctggcttgtagggcacagtctgtgtagcaacaaggaacatacctggtgtttagatcagatgttcaatgactcatgtcccagagaaggggcctgcagccgtattggtcagttggggagcttgtatactcaggccattgaggttgccatggccaccattttgggaatcttttctttgggagttgccatcagaatttagggcattaaaaaagtccttaaatttaggtaatgtttgccttaagcagatggtctttgccttttagaactgtcagaacttgtttacccttcaagctgggcactgtggtaagttgactctttgggtccttggttggaaacatgagaatcccattctggctgactcaagcagacatggattttattcgaaggatgtgggggtggctttgagcatagaggcgttgggatggactgaaccatgggcccaggggacaggcacaggctgcctgtgtatttagggcactgcttgggttgcctggagagtggtttattggcccagattctgccacttcttggccaggggaggcctttcatggacagcctcatcagagtggcagcagagagaagagcagggcaggtcctcaaaggaacactgaaaaggttctctgaaagacaggggcgtagatactgagctggcaataacagcgctgatccactggaatggggaagggcctcgagctgttctgtcaacacggagttgtttgtcaggcgtcatgggtatcattttgtgcatctgcccttgttcagtgtttccttgtaattttgcggaaaaaagtctgcttagtgttgaaccagacattctgcagcctttaaaagagaatggaaatggagagattgtaatgtgttcattggtgacttttgacacggatgctaacctgtaagatgtgcagatatatcatgtgcaaactgttaagatgctgtcaacattttgaatgacttcttgcaaatagtaaggaaattaaacacgcacagagctgggcaaatgctagaggatggtgttgccttttgcatcttggtgggaaagagatatttaagggggtgaggggagctcagcaacagcgacttaagggcctgctaggagcggggagaagttggttgctggggtgtgcggcctctgtagcccagtcctccgagtatcgtgacaggtggctgggtgcctcagtgctcaggtatgggctcctgttcctgccgcatgggctcctctgctgctgctgctgctgctgctgctgctgctgctgctggcccgccagttcccatggactctccctcacctgtgcttccttctgctccccgacttcatggttggaacgtgctgtcttcccatccctctgggcacgtggctcctcttttacatgcatgcctggcgaatagtatatccccagtaaatgcttgcagaatgaatgtctttcctgaatgttctgctctgctccccagcccccagaaataaaacagaaatgctgtactccttccctgtctcaggcccaggagcattattattattttttttaaatctcttgtggcacttttctactttctcctccacagtacagctgcttgttgagaggcagtatatgtcatgtctaagaagagtcctcaagtgaagtctggtgcagcttctttctagctgtgtgctttcaggaaagccttttgaatttggagcctctgtttcctctagctttactccaaaggaaacaagtgtaagtgcttggcacctgcagcctgagcgtagttcatgccgcccgtattcctggccagcctccgttctctgggacccggcaggaatgtgtttgtcgcctctggccctgtgcaccctggcttcccatcatacctggagaccctgggacaaatgcctgtggagtggatgagtgagtgcatgcgggtccactcagctccccggcaggcttcagaatcttccctgtattctggaagtaagtggcgtcgctgcccagtttaggagagtgccatgtgggactctgttccatcagctgggttggtgcagtgggactgaactttcttctttggttgccctctgcaaacagccatgcagatgttattgatgggcagttgcaggtagaagcatttttggccctacagggtagatctgccagcatggcaggctgatcagccacgggtgccacgtggctctggaggggcttggcgcctacgttagtcagctcgggctgccacgacaaaataccacagactgggaggcccaaacgtattttctcacagttctggaggttgagagtccatgatcaaggcactggcaggtttggcttcttcccattctgtgcctcacctggtcttttccgtgtgtgtggtcttcagtgtttttccgttctcaggaggacaccagtcttgttggatgagggtcccacccttaagctgccatattaccatgatggcttccttaaagaccttatctccagcgacagtcaccttggggtgtgagcctctgcagaggaatttgg

SEQ ID NO: 13322 - DNA, 481 bp, Homo sapiens
tcaggcgtcatgggtatcattttgtgcatctgcccttgttcagtgtttccttgtaattttgcggaaaaaagtctgcttagtgttgaaccagacattctgcagcctttaaaagagaatggaaatggagagattgtaatgtgttcattggtgacttttgacacggatgctaacctgtaagatgtgcagatatatcatgtgcaaactgttaagatgctgtcaacattttgaatgacttcttgcaaatagtaaggaaattaaacacgcacagagctgggcaaatgctagaggatggtgttgccttttgcatcttggtgggaaagagatatttaagggggtgaggggagctcagcaacagcgacttaagggcctgctaggagcggggagaagttggttgctggggtgtgcggcctctgtagcccagtcctccgagtatcgtgacaggtggctgggtgcctcagtgctcaggtatgggctcctgttc

SEQ ID NO: 13323 - DNA, 4833 bp, Homo sapiens
aggttcagggagcaagtttccgaggttggaaagaagtgacttcactgtttaacaaagatgatgagcagcatctcctggaaagatgtaaatctcccaagtccaaagggtaagtcataactgtgtaagaaaatgatcatttcaggagagggaggaagtcactgaggaggtggaaatgaagatttgatggcataaatgcagtgtaactggaggcattgtggggcgcggcgagtccatgtttccctccccactccgtctgtccctgttgagtggcagacggtcatggacttcatgatgtgtgcttcggagttaacatccatcccttgtgaataaacagaaatgggctgggcatggtggctcatgcctgtaatcccagcactttgggaggccaaggcaggcagatcacaaggtcaggagttcaagaccagcctggccaacatggtgaaaccccgtctatactaaaaaaaaaaaatcagaaattagctggacatggtggcatgtgcctataatcccagctactcgggaggctgaggcaggagaattgcttgaacctgtgggagacggaggcaacagagcaagactctgtctcaaaaaaaaaaaaaaaaaaaacaacagaaatgagttgtggtgttcgatgaaaaaaaaagaaactgtactttggataaaaggtcctgagggtctctgttggcattttgaaaggttatggaaaagtggaaaataacttagaattataaattgaacttattagccttaaagcagcctgtagcctcacttaagatttttagtagtttcagaaaaaaaccaaaccaaaacaaaacaaaaacaaccaccaccaaaaaaaacactgttaaaaatacaaaggattgactggtaaactgtaaaagattttagagaattgaatacatttaaactgaccttgctactttatcatcagtgtttcagaatttttaaaaagtgtaaagttgaaaatgtaagttcagtgactacccaatgatattaccaatggcatatttgctccgtgttatggaagctgtttgattagaagatgagtcctggtgagtctacaagtacagagttggcttttgtttgaggactgtgggcccccggtctgcttctctgcacttctgtgcactgaggacagacacatggcccttcgtgctctggcggagctgtgacttcaccttcatccttcatctgtagaggatgggtaaaccggttccctggttgtcaggcgacctgctaatacatcagcatctggaaggagagggcctgggcactggtgttcttaacaatgttcccaggtgatgctcgcggacagtcagggtgaagagtagtttaggatctttcttccctagctgtcgcttgctaccatttcctttttatagtagatggtgttctgaattcttatttttgttgagtaaattacctactaaatgcttgaccttaccttgctgtgttaatccaattgaaaacctatttgataaattgaatagatttcccttgtttcttaatctagaccctggattctcatagatctgatttgctcaaaatcttgagtaccaccttcctattgccttgaggttctctcttgtgtgataatacttctttcttgtcagaactagttctttgcttatgtattgccaagtggtgtcctaaaatgtggcttttacacacttcattaacaacatatagtgactaatttttccttaattttaatatttgaaacttttcatatagacttgtgttagttttctaaacaattttttaaaattttaaagaattttatgtttgtaaaatggataaagcttgaggccctaagacctgggtcaccaacacctaactctttcatctcctatagaactaacttacgattaaaagaagagttgaaggcagagaagaaatctggattttgggacaatttggttttaaaacagaatatacagtctaaaaaaccagatgaaattgaaggttgggagcctccaaaacttgctcttgaagacatatcggctgaccctgaggacaccgtgggtggccacccatcctggtcaggctgggaggatgacgccaagggctcgaccaagtacaccagcctggccagctctgccaacagctccaggtggagcctgcgcgcggcagggaggctggtgagcatccgacggcagagtaaaggccacctgacagatagcccggaggaggcggagtgaggggggctgcgtggcaagtgtgccccgacatggtggccttttatgagtataccatgtagttgttgagtcttttccgcgttagaaagaatagagagtctactttttgcctatatttgatatttggacctctgtttctttatttaatgaactctcacacacactgtgactccttggtgaacacgtgcagggattgtacatttgattgccttattgcagaaatattcacctatcagtccatgttttgcagaaactggagatgtgaatttatgatgctctcccataatacagcagtaatgatttgcagtttctcacaaaatgattttcatgctgctctgtgttgtagttctgtttcagaacttccgtacctttttcttgtatgtagcacgtataaatgcagctgtcatgcagttcttttcttttgctagaaaattagtcaggaggtaagatgaatcttccaaagttatgttaaattttgtttaacttgacaaattaaactttgttcttattaaacaaatacgtaaacaaatactggaaaagcaaagcttatatttgggagtaaaatgtatcttaaaatgcatgttcatcttttgctgagggaggaatagcttcttgtatgtccactggatagtaacagtggttcttttttggaattttatttttacctcttttgaacttctaaatcggtccctttattttcttaaaacatttgctctcttttttgtttacagattaaagaagtatggatcaattttagtcagttgataatttcatttaggaaacattgtcttgctcattatagagagttaagactgtgcataaaatactgaagtgcctcttttttattaggctcatatgtttgttcttgcaaagcgagatgcctattgtgattggtgttagatctgtaagaagctgtgttttttccacaagaataatcgacgaccggtttgagagcatctctcgcgttctttttctgtctgcttactgtccttgacaatgtgatcctgcacagtatcaggtgccagttatgcgtccctggaaggttggctcttatcagcaagtcctgcagatatctcttagataaaagtggtttgaaagaaaaggtatatttttcttttttgtttaaaagtaaaataaaacctccagttacactgtgcattcccctcacgtaaaaacaagacaaaaaccctttcctgagttgctcggcatgcactcctgtgctgtttcatgcatgtggatgttccttccgtttgttcctgtggaataactgagtgtgcctgatggcagaacacactgcagtgttatcagtgtctgcatgttttttaatagaacaggtttacttgatctgtcatctgttatgcaaaaaacagcaattacttttgcatccatctagctaaatctataatctgtgtcaatcacttatacctatcaatcatccgtatctattcacctgtcctctatgtctgtcttctctcagtctacatccatctagccttctgtcaatcatctacttttttttttaatagaacaagaagtttacttatcaagtcttgaaagggggacatgtttcaattggtgttcaaacaaaaattccagcttgtattagaaccttgaaatggtgaagttgtggaggttttctttgttccataatacagagacaagttcataatttttagtataacagctaagttgacaaattctaagtttcctcaggtaaatagtcataactgtccttttccctagagaagtgcttgctgggatagtaaaaacatacaccatttcatgacttctgcaaatactttccagcggaagtcagtgtaggtttgtttttggctaacatggtcttgctgcgcaggaatgtaaacactgtgtttgaaactctggaaatcacgtgtgtggggagatggggacgcttcccatgttgtggggagctctgtggctgtgatggctgcagttgccgtgcctctgttggaacgctaagtgcctgcaactcacgtcaatcatagaattgtgacgcacagttggcaaaatagttctttatgctatttctcaaaatttgaggacaaacccagattgggattggaatatgcactgtaaatcaaatttttcttatctacaaagactaatgtgaaaatgattttttcttctgtgcctgattaaattaactgtggtttttaatataaatatttattggtgtgctttgggagaaaaattatcttttcttgaaagaagttatcaaagcaaatttattatcttcacaagttaatgggagaatgtggttttgattctgggtgtttgaattgtgtaaacacacagcttccttgtgtgaagagagttgtcctgtgctccttctactgtactttttttattttttaataggaaagtgatgtgcttcagagaagggttcctccttaatgttgaggttttttaaaaataaaaatactgtttttaagctctttccttattggtttgcatgattattggcatctgcttacgatggctttaatcactcagagctaatggcacctttcctatttagcctcattttagaatgcagtcaacacatgtagacttttcacaaataaatgaacaacttcaaccttggttttcaagatgtgtcttctgcgtatttgaa

SEQ ID NO: 13324 - DNA, 1334 bp, Homo sapiens
cagtgcagctccttcaacctcgccatggcctctgccggaatgcagatcctgggagtcgtcctgacactgctgggctgggtgaatggcctggtctcctgtgccctgcccatgtggaaggtgaccgctttcatcggcaacagcatcgtggtggcccaggtggtgtgggagggcctgtggatgtcctgcgtggtgcagagcaccggccagatgcagtgcaaggtgtacgactcactgctggcgctgccacaggacctgcaggctgcacgtgccctctgtgtcatcgccctccttgtggccctgttcggcttgctggtctaccttgctggggccaagtgtaccacctgtgtggaggagaaggattccaaggcccgcctggtgctcacctctgggattgtctttgtcatctcaggggtcctgacgctaatccccgtgtgctggacggcgcatgccgtcatccgggacttctataaccccctggtggctgaggcccaaaagcgggagctgggggcctccctctacttgggctgggcggcctcaggccttttgttgctgggtggggggttgctgtgctgcacttgcccctcgggggggtcccagggccccagccattacatggcccgctactcaacatctgcccctgccatctctcgggggccctctgagtaccctaccaagaattacgtctgacgtggaggggaatgggggctccgctggcgctagagccatccagaagtggcagtgcccaacagctttgggatgggttcgtaccttttgtttctgcctcctgctatttttcttttgactgaggatatttaaaattcatttgaaaactgagccaaggtgttgactcagactctcacttaggctctgctgtttctcacccttggatgatggagccaaagaggggatgctttgagattctggatcttgacatgcccatcttagaagccagtcaagctatggaactaatgcggaggctgcttgctgtgctggctttgcaacaagacagactgtccccaagagttcctgctgctgctgggggctgggcttccctagatgtcactggacagctgccccccatcctactcaggtctctggagctcctctcttcacccctggaaaaacaaatgatctgttaacaaaggactgcccacctccggaacttctgacctctgtttcctccgtcctgataagacgtccaccccccagggccaggtcccagctatgtagacccccgcccccacctccaacactgcacccttctgccctgcccccctcgtctcaccccctttacactcacatttttatcaaataaagcatgttttgttagtgca

SEQ ID NO: 13325 - DNA, 1363 bp, Homo sapiens
ggaatttcgcatatctccttcgcagtgcagctccttcaatctcaccatggcctctgccagaatgcagatcctgggagtcgtcctgacactgctgggctgggtgaatggcctggtctcctgcgtcctgcccatgtggaaagtgaccactttcatcggcaacagcatcgtggtggccaggtggtgtgggagggcctgtggatgtcctgagtggtgcagagcactagccagatgcagtgcaaggtgtacgactcactgctggcgctgccacaggacctgcaggctgcacgtgccgtctgtgtcatcaccctccttgtggccctgttcggcttgctggtctaccttgctggggccaagtgtaccacctgtgtggaggagaaggattccaaggcccgcctggtgctcacctctgggattgtctttgtcacctcaggggtcctgacactaatccccgtttgctggacggcgcatgccatcatctgggacttctataaccccctggtggctgaggcccaaaagtgggagctgggggcctccctctacttgggctgggcggcctcaggccttttgttgctgggtggcaggctgctgtgctgcacttgcccctccggggggtcacggggccccagccattacatggcccgctactggacatctgcccctgccatctctcgggggacctctgagtaccctaccaagaattacgtctgacatggaagtgaatgggggctccgctggcactagagccatccagaagtggcagtgcccaacagctttgggatgggttcatatcttttgtttctgcctccttctatttttcttttgactgagggtatttaaaattcatttaaaaactgaaccaagaagatgactcagactcccacttaggttctgctgtttctcacccttggatgatggagccaaagaggggatgctttgagattctggatcttgacatgcccattttagaagccagtcaagctgtggaactaatgtggaggctgcttgctgtgctggcctttgcaacaagacagactgtccccaagagttcctgctgctgctgggggctgggtttccctagatgtcgctggacagctgccccccatcgtactcaggcctctggagctcctctcttcacccatggaaaagcaagtgatctgttaacaaaggactgcctacctccggaacttctgacctctggctcctccgtcctggatgtccaccttgcagggtcaggtcccagctatgtagacccccgcccccacctccaacactgcacccttctgtcctgcccgccccgcctcaccccctttacactcacatttttaccaaataaagcatgttttgttagtgaaaaaaaaaaaaa

SEQ ID NO: 13326 - DNA, 1363 bp, Homo sapiens; identical to SEQ ID NO: 13325

SEQ ID NO: 13327 - DNA, 2551 bp, Homo sapiens
aacaggccgggcgcggtggctcacgcctgtaatcccagcacattgggaggccgaggcgggcagatcacgaggtcaggaaatcgaggccatcctggctaacacggtgaaaccccgtctctactaaaaatacaaaaaaattagtcgggggtggtggcgggcacctgtagtagtcccagctactctggaggctgaggcaggtgaatggcgtgaacccggaaggcagagcttgcagtgagccaagatcgcgccaccacactccagccttggcgagagagcgagactccatctcaaaaacaaacaacaacaacaaaaaaccagcaacataaaaataatattatctggccgggcgcggtggcttaagccggtaatcccagcgcagtgcgaggccaaggcgggcggatcgcttgagtccgggagttcgagacgcctgggcaatataacaagaccctgtctatacaaaacaaaacataaattagctgggcacggtggcgtgtgctgcctgtagtcccagctactcaggaggctgaggcgggaggatcgcttgagcccagaaggtcgagactgcagtgagccgtgatcgcaccactgcactccagcctgggtgacacagtgaaaatatttctctaaaataataccaatagtatgccctttaatttgtaccttaggacgtagttacataataaaatgcagacttgttatctccattttgcagagtaggaaacgaaggctcgggaaggttaggtgagttccccatgtcaccgcgctgcttaagtggtgaagcggagtctcaagctctgttctaccctaagcctggcgccctcaccctgggtgagtctggacgtctgccagcccgaggcgggcccagcgaccccagcctccagcgcccccctctgacaagcctgggattcgcacgcccgctgccgtcagggacagggtctctgcccctcctccggggcggtggtccagtgacgtcaccgcttctttaagacccccgcctccgcccctgtcccgacactcggcctaggaatttcccttatctccttcgcaggtgagtccggggctagtgtgcgtgttggagagacgcctcttggggccgggtgcagggtggtggcggcgtgggtaggggtgcgtgcgaactcgggctgcggccacctggatgggcgagtccctgagggggtcggccggtccgcgcccaagcctccgaggtgatagggtccttcggggctcccaagggttaaacgcccctcccccctccccagggacaaagactccgaaacccctggcgcccctcccccacctgccttgcctctcggggcggggcgcccctcccccctccccctcacctgggggagcggaccttgcggccactgcagctatagaacccctccagggcgcgcggctcccaggctggggtggtcgggtgggccggggcgccctcggacagagtctttttcatgcagtgcatgaaaaagaaaggggcaggggcacactcagaggggagaggcctgggcgcctataccagcgcggccccgaccctaactcggccagaggcctaagggccggacctgagcgctggggcaccgtgccccagccagtctccccaaggtggcctgctccgcccaggcctggggcccccggctaatgagtagagcctgccctccgaccgctgccggccgggaaaagtttaggtccaagccgtacaatgaaagtactctgggcagtgggaggccacagcccggccctagtcagaagtgattccctccacgacctccaacactgaggggacacaggtgcaggccaggtggcggtgggagaactggtgttgaggggagtctagcacggcattttcgtctagaattcataggaaaaggccctcagccttgaggctatgctctccggcgcctagggcaggtcagaagggtggggccagggagttatccactggctttgggggaggaactgcttttagatgggggattaatgatgcttttcttcatctctcctggtcctggtgtctgccagcctggggtgtggaaccaagttgtgagggacattgggtggtgggaggaagcttaggatctccaatcttagtgttgaaattaacaagttttggttgggcacggtggctcacacctgtaatcccagcactttgggaggcttgaggcgggcagatcacctgaggtcaggagttcgagacccgcctggccaacttgatgaaaccctgtttctactaaaaatacaaaaattaagaccaggtgtggtggctcatgcctgtaatcccagcactttgggaggctgaggcgggaggatcacgaagtcaggagatcgagaccatcctggctaacacagtgaaaccccgtctctactaaaaatacaaaaaaattagccgggcgtggtggtgagcgcctgtagtcccagctactcgggaggctgaggcaggagaatggcgtgaacccgggaggcagaacttgcagtgagccgagatcccgccactgcactccaggctgggcgacagagcgagactccgtcttaaaaaaaaaaaaaaaaatta

SEQ ID NO: 13328 - DNA, 608 bp, Homo sapiens
ccagttacaaatgctctttatttccaactcgagggtggggatgttggggagagggaggtgatgggcaggccctccctgacaactccagggttgggagggcatggtctgctccctggttttggagccaacgagctgctgctgttttggtgaggccagggttcctggggcaggggagggctcagaagagaaggaaggccagccagtgtcctgggcaacggaaggaaacaattactggggaggtgggggcaggccagggttcccaacacctctaggctgcccaacttgggggagaacatcaaaggggaccccactgagaagagctcagccaggccagctgacccagccctgcagccaggtgtagcttgggcttttggaaagtgggttttcctggggaaggaggttgtgatggagcagggcatctggtcatcaggccaaggtcgaaagggcggggcagtggggagcagtgggctcccaggggaaacctccgcctcacacgtagtccctcttgtccagtccagatgcacccgagcgggaggggatggagtagcccagccgaggtccgcggggccgctcgacctggggcggggggcacgtgcagcagaggagcc

SEQ ID NO: 13329 - DNA, 448 bp, Homo sapiens
tttttttttttttgagacggagtttcgctcttgttgcccaggctggagtgcaatggtgtgatcttggctcactgcaacctctgcctcccgggttcaagcgattctcctgcctcagcctcccgagtagctgggattacaggcatgcgccaccacgcctggctaattttgtatttttagtagtgacggggtttctccatgttggtcaggctggtcttgaactcccaacctcaggtgatcgcctgcctcggcctcccaaagtgctgggattacaggtgtaagccaccacacctggcctacagcaaaatgaaatctttagttcttaaagttttatatatgatatcacttaagtagactgttgtttccaaagaaaacaaccatctgtactattgcctctgtacagttccagaatgaacatcctgcagtttctgaaacagcatttgtgggccaa

SEQ ID NO: 13330 - DNA, 448 bp, Homo sapiens; identical to SEQ ID NO: 13329

SEQ ID NO: 13331 - DNA, 1777 bp, Homo sapiens
gaacaggggcaatgacacatgctccttggcttcctagtcctgatcccttggggttccttgatcctagggtcatctgacttagatccatcctcccttcctctaggcaccaggggccatggctggaggtggccacccctcagtcctgtacagattctgtacccactggctggagacccccatgcagctgtctcctgctcttgctgcggggagactgaactcagggctctgctcactggctccctcccaatggaagccttctctgggcttcacagcattgaatattcctccagaacagcttgttaaatcaaattttttttttttttagatggagtcttgctctgtcgcccaggctggagtgcagtggcacgatcttggctcactgcaaactccgcctcccgggtttaagcgattctcctgcctcggcctcccgaatagctgggactacaggtgctaccacacccagtaatttttgtatttttagtagaaacggggattcactatgttggccaggctagtctcgaactcctgacctcatgatctgcccttctgggcctcccaaagtgctgggattacaggcatgagccaccgcacccggcctaaatcaaaatgttctccctgtggcagaagtgtccattagactgggagcccctgaggcagagacaactgtcatttaaaaaatctctggccaggcgcagtggctcatgcctgtaatcccagcactttgggaggccgaggcaggtggatcacctaagttcgggagtttgagaccagcctgaccaacatggagaaaccccatctctactaaatatacaaaattaggctgggcgcagtggctcacgcctgtaatcccatcactttgggaggctgagacaggtgggtccaaggtcaggagttcaagaccagcctggccaagatggtgaaaccccatctctactaaaaacacacacacacacacacaaaaattagccgggtgtggtggtgggcacctgtaatcccagctactagggaggctgaggcagagaactgcttgaacccggaaggcagaggttgcagtgagccaagatcgcgccactgcactccaacctggacaacagggcaagactccctcttgaaaatataaaaaataaatatacaaaattagccaggtatggtggcgcatgcctgtaatcccagctactcaggaggctgaggcaggagaatcacttgaatccgggagggagaggttgcggtgagctgagattgcgccattgcactccagcctaggcaacaagagggaaactccgtctcaaaaaaaaaaaaaaaaaatctcttggcagtgtctgacaaagaggaggggcccaataaccccccaccctttttttgagatggagtttcgctcttgttgcccaggctggagtgcaatggtgcaatctcgcctcaccgcaacctctgcctcctgggttcaagcaattctcctgcctcagccttccgcgtagctgggattacaggaatgtgccactacgcccggctaatttttgtatttttagtagagacagggtttcgccatgtttgctaggctggtcttgaattcctgacctcaggtgatccacccgcctcggcctcccaaagtgctgggagccgtaagccactgtgcccagcctacactttttaaaaatacaaatacaggtataaagtgtgaagcatgggttactggaatgacatgatgggagggtgattagggatctgctccaccctcaagggggtgcttgtcctgtatgaaaaaaggcacatcctggcc

SEQ ID NO: 13332 - DNA, 139 bp, Homo sapiens
ggcacagatgtgaagctggactggaccctccatcagaggatcaggtgggtgcagagctggagaatcatccctaaactctccatcctgtcatggctggacaggtgcaggagcagacctccccagcttctgaaaagctctt

SEQ ID NO: 13333 - DNA, 2291 bp, Homo sapiens
tagattttaaagtttcattttgtaagtcacaccagggcaggaagtagaatagagatttgagcccaagtgtacctgacaagtctctctgcctgcactcctagacaagatgatcaggacagacctcattcttctttggttgttcccaggcaggaggaaataaatgtcacttcctatgttggaagagctgaggggtggtggtttagcagtaagagatgaaaaatctgattaaacgtctcaggcacactatggatctcagggctgatggaggacaaggaggggacaagggaggacgcagtccagggtgcacccccttgttagtggctggggtcagtggctgaccaagtaggaggggagaggggtaagaaaagtagctttcagggagaagaagctgtgcgtgaatgtggacatgttcagcatgagatgcccaagaatcgtccccagtggtcatttggatgtgggtctggagctgaagggtgagacacagtgggtgtgtttttcagtcagttatgggttctaatcaggaacaagaagtgtgtaagatcgtcccagatgagacggtgaagccaggaccttcagaaacgcattcgaggggcaagaggaaaaggacagcgaggtggagcaggaggaacaggacactgaggaggggccggagatgcagcgagtacagagcaaacaagtggctgtaaaggggaggagagcgcagaatctggggaggccaatggagagtgaaggagagggaggagggtgaaaagtccgaactagaggggttaggggcagagtgaagttctcggggcgttgcctggatgaggcccgggaggctacagacagcgaggaggggcgcccgtcggaggggactaggggcctgccgagaggtggggaccttaaagaagttgctgaccaaccacgtcctcggcgcagccaagagcccgacccgggtcaaaggcccgatggcccctgcggaactgggccaggacccgcgcagccgcgttcgccccctcgaggtcgtgagcgcgcgtgcccagagcaacgggcattgtcgcctgaggcaggcgactggggattggccccgcccccggcttccgcgcggattggctggggcggggcggcgcggctgcagtaggctagagagtccgcacctgcgccgcggccgtggggagagagggtgcgtcccggcagtcccgcacgacgggccccgcctcccctggtgaccccacgctccggcctcggggggagtggcggtcggcgcgccgagaccctcgggagccccgcccagacgcctgctccgcttccaggccacccgggctctccagccgcgctcgctcgtagagatcctagacgagttcgacagcgaggtcccgcagagcaagacctgccagcagatctccgaggaggacttggagaggcaggcggacacctacactgggcgcgcgctgcgcctcctcttccgcagccccgtccgcaacccgtcgctggcggagagggtggtacaattggaacagcgcgggctctcttttttccggatgcggccgcggggcatgggaccggctgggcgggaactgtcactacccgggtccgccgtcccctaggaaagagctccgacgattggagctttgggggccggggatgggggtggggtggagaggtcgccgtcggcctagctggggctgcagggtaggatctatcagaaagccgaggctgcacagcctggggagtggagcgggcaggcgtctcacgccccggacctccccctgccctgcctctcctactcttgttgcaggcgaagttcttctgtgttgtgcaggcggagctgaaccattgcaacagcatgggcgccctggagatgcacgagcaggtggagcagctgaagcagagcatccaccgcgtgcacctctactcccggggcgaggatcaacctctccccgtgctgggccctgggcgggggtctgagcccagtgcagccaggccgagggctaggtgaccacctccattcttccagttggatttgccctccttggatcaggttttatccagagcaggaaggggcctgggcagtctggacctgggaggagaggcgctgcccctagctagattctttagttaggagactgacttcagctctgctacttccttcctggctgtgtgatcctgagcaagttgggccacctttccgagagagagagccctcactgctcaccttggtgagtgttttggagtggtggatgaaggcctgtaggtagggctggctcaagcaaccaagctaacctgaatcaattaaaaaaaaaaaaaaaaaa

SEQ ID NO: 13334 - DNA, 38771 bp, Homo sapiens; identical to SEQ ID NO: 12795
  misc_feature (29356)..(30880): n equals a,t,g, or c

SEQ ID NO: 13335 - DNA, 3219 bp, Homo sapiens
ccccccgcccctttttttttttttttttttggagacagagtctcactctgtcgcccaggctggagtgcagtggtgtgatctcggctcactgcaacctccgcctcctgggtttaagtgattctcctgcctcagcctcctgagtagctgaggttacaggcgcccgccaccacacccagctaattttttgtatttttagtagatatgcagttttgccatgttggccaggctggtctcgaactcctgacctgaggtgatctgcccacctcggcctcccaaaagtgctgggagtacaggcatgaaccaccgtgcctggccatttttaccgtttttttttttttttttgagacggagtcttgctctgtcgcccaggctggagtgcagtggcgccatctcggctcactgcaagctccgcctcccgggttcacgccattctcctgcctcagcctcccgagtagctgggactacaggcgcccgctaccacgcccggctaattttttttgtatttttagtagagacggggtttcaccgtgttagccaggatggtctcgatctcctgacctcgtgatccgcccgcctcggcctcccaaagtgctgggattacaggcgtgagccaccgcgcccggcctatttttaccgtttttaagtatacagttcagtagtaataaatacatttctattctttttctcctcccttcaactccccccacccacttcctggcctttgataaccaccagtttatttatctttatgagatttagctctgacatatgagtgaaaacatgcaatagttgtctttctgtgcttggtttatttcacttaacgtgatggcttccagttccatccatattgctgcaaatgacaggatttcatttatttttatggctgaataatattccatagtgtatgtataccacattttctttaagcacttaggttgacttcatgttttggccattgtgaatagtgctgcaataaacgtaggagtacaactatctccaatatattgatttcctttgttttggatattgctggatattgctggatactattgctggatattgctggatactatgttttggatattgctggatactatggtaattccgtagttttagttttttgaggactctatattgttctacatagcggccttactaatttgcattcccaccaacagtgtatgagtgttccttttctctacatccccgccagcatctgttactgccttttttttttttttttttaaaaacagagtcttcctctatcacccaggcaacctccacctcccgggttcaagtgattcttagcctctgccacccaagtaactgggattacatgtgccaccatgcccagctaatttttgtaaatcccaaagtcctgggatttacaggcgtgagccaccttgcccagccttgcctgtctttttgatacaagccattttgactggggtgagatgatatctcattgtggttttgatttatatttctgtgattatagtgatgaacatttttttcatatagcttttggccatttgtacgtcttttgagaaatgtcagttcagatgttttgcccatttgtaaacgagattatttggttttctgctatcgagtttgagctctttatatattctggtttttcgtccttttttagatagacagtttgtagacactttcttctattctttgtttatctcttcactttgttggttgtttcttttgctgtatagagctttttagcttgatgtaacacccattatctctctttgcctgtgcctttgaggtcttacacaaaaaatctttgcctagaccaatgtccttctttcacttctttggttagattgattcctaggtgttttacttttttttttttgctattgtaaatggaattgctttcttggtttctttttcagattgtttactgttgttatatataaatagctactgatttttttttttaattttagtttttaagaagagatgatgtctcactctgttgaccagactggtctcaaactcctggcctcaagcggtcttcccacctttcccttcgaaagtgctgggattacaggcgtgagcctaaccaaagcctaaccaaagagtcattcttctccaaccctctcaaaaccttccaagtgttttttttgtttgttttttttttttttgagacagagtcttgctccgtcgcccaggctggagtgcagtggtgcaatcttggctcactgcagcctccgcctcctgggttcaagagattcttctgcctcagcctccccaagtagctgagattacaggcgcccatcaccatgcctggctaatttttgtatttttagtagagtcgggatttcaccaggttggccagtctggtctcaaactcctgacctcaaatgatccacccacctcagtcacccaaagtgctgggattacaggcatgagccacaacacctggcctaaaaccttccaagtcttaactgcaattactcaactagttctgatcaagaccaagaaaattaagaacagtaagtaaaagcttgtaagttacagttagctttcaaatttcatgacatatagattttcttagtatacagtaagggaaaataattctttgtaggaccttgtactgtcttactaggtggcattctattgtcttctgtcacagggcttaaataattgtcaaaataatatttaaagttagtactgttaaactctcttaaaaatttattttcctttcctgttcaactcattggaataagaaaagagttgatttagtgatctatgcacctaaggattaaaattcatgttatttatctcccaatattgcttatcttcatgctttaggaatgaatatataccaataactcacatttttcaataattcatataatcacatcaaaattcctattttggggtcagtaaatactgttttcaatcttaatttcttggatttacttattagtttagataagtaaaaccttaatggaagttttgaaatgtattatagatttctgaaacatggcaatttgtttactgaggtcaaaacttcagatggagagattattttttaaaaataaaatagttacgtgcttgtagcctttttacataacttgaattgcagaagattttcatttctctttaaaaattattaggcttttgccaagttggaaacgaggtatagcgcctgtagtcctagctacttgggaggctgaggcgggaggattgctcgag

SEQ ID NO: 13336 - DNA, 5775 bp, Homo sapiens; identical to SEQ ID NO: 12799

SEQ ID NO: 13337 - DNA, 738 bp, Homo sapiens; identical to SEQ ID NO: 12800

SEQ ID NO: 13338 - DNA, 89 bp, Homo sapiens
acccaggaggcagaggttgcagtgagctgagatcgtgccactgcactccagcctgggcaacagagtgagactccatctcaaataaaaaa

SEQ ID NO: 13339 - DNA, 8438 bp, Homo sapiens
gaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagtaaggaactgtcttcttagagaaaaaagtttaaataaaagcatagagtgaaccctctaaaaaagaaaaaaagaaaagcaaccattttgtgctttctggagagcaagccaaagataacatgtaacttaataacaaaatgtagacaaaaacctagaaaatttatttctgcctaaacaaaaacctaaaaatacaaaagaataaggcatttttctatagattatttgtaaatggagtctactgtcagcaaaaggttctgattcactttgacattggacaggttcggtaataagtcagttggcgtcttttgctttagataaattaatatgttatagttatataatatagatatatgttatagttatataatatattatagatatataatatgttatagttcctatgaggccataattggttgggtttttttatttagtggacttgcaaataattagatgtaagcgtgtcacttaaaagatcctggatttaaatattagttcacacatgtacttgctatgtatgtgtctttgggtctatctgagcctcagttccctccctttgaaaagaggaatgatggccgggcacagtggctcacgcctgtaatcccagcatttgggaggccgaggcaggtggatcacctgaggtcaggagttcaagaccaccctgaccaacatggcgaaaccctgtctctactaaaaatacaaaattagccaggcacagtggtgcacgcctgtaatcccagctactcgggaggctgaagcaggagtattgcttgaacctggcaggcggaggttccggtgagctgagattgtgccactgggctccagcctgggtgacagaacgagactctgtctgaaaaaaaaaaaaggaggaatgatactacctgttaatgatactacctgttaggattattggggtattaaatgagatgatttgacaaagtgccatttaaagtatatagcattagataaatattttatcttttgtggactttaacaaatagtttattgatggaaattttttaaaaaagcttttaagttacacattttaagttcctgctactgaaagcaggattaactagtctgtagaataatagtaattttttaattttgtctccttagctcattacctaaaggacttattgtaaataagctatttaagatcttaagaaatactgtatttttttaaatggaaggctaagaaaaacataaacagcctaagcatgtgcattaaaactttgttgacttataagattattcaaaatatgttattttaattttggaattatattgtttactttaggcagcagaacttgctgaattcactgccaagattgcacttctagaggaagccaagaagaaaaaggaagaggaagctactgagtggcaacacaaagtaatcatttattcatttactagcttttattgaatagcttttatacccaggattatgctgactttgtagtgataagtgtaagatactgtcataatttagagtgggaaagatactcgtgttatgtgtattgtaaatatctatctacagatataaaccaagtactttgggaacacagaagaggtgattaatttctgggggaccagagagttgtcgggagacccatatacatttaagctgggtcttgaataatgaattaaattttgggggtacaaaagattgggatgtaaaattgggaatagttagagactgaagaagtagtcattctagacagagggaactgaatgagtataggaagtatgaatgtatataatagatttgaggataaccaataagcagccgaggcttagtgttgttcagaaatgttaggagatgtggccctcaagtttgataatagggaattgtgaaaggctttaaataaatgctctgctacagcaaggcagtgggagtatcgattgacttggggcttagaagatttcaaaacaggattgtaacatgatcagatatgattttataaaaaccatgtagtgatcagtgtgaagaaaggattgggatagtggatacttaagagataaagacccaaactgaggatgtgaaaatgagaataaagaggaatgggaagatataagagacattttgtggtcacaaaaaggcatgggaaccagtgattggatatgaagttgaattatttttatttttttagagacatggtcttactctgtgtcccaggctggagtgcagtggcacaatcataattcattgcagctttgaactcctgggctcaagggatcctcccacctcagcctctgcagtagccgagactacaggcatgcaccatcatttttatttttgttgagaatggaggtcttgctgtgtaacccaggttggtcttgaactgctggcctcaagcagccctcccatctcagcccccaaagtgctgggattgtaggtgtaagccactgtgtgcagctgacaccgagatttctaatatgagtcctaagtagatgaaaccactgttgtctaaagtagcacacaattgtaaaatcaggctttggttggagagtgggggaatataagataatgagagtttaattcaaacaacattaactcttaactgaaaagataatttttttacccccaaagatgatatttagttttagaagatgatttttctacaataaaatgtacttatacagaaaacagttttcttgcactcttaagtaaatctttgtagcagtttaaatttcattgggtaattttatatgtattgaaaattagttatatataaataaaactacaaaaggaatgctactgttaatttcccagttactctacttgtttattagaattttttagatcccttttagggatgatttatgaaatttagagacacataaactttaaaaaattagcatattacagatatcaagtctgtgaattatagaaaattagaaaatgcacacaaaagacaattgtattcccataaactaggggaaatactgcaaaaccttagtacatattcttccaggatacttcctgtttatatattcaacatgaaatcttactgtatgtactatttcattttagtcaattttcatctcagaatattagactatattaagaatttcccaaaaagtctcatagctaatttgccagacaagtgttcagaggactttgcattgtctgtatttgctgtaagtctcttttaatggagggcagtttctctttttattattttgatttattgaagggacctacagaatgtctcacctcctatatttgtttagttacttccttgtgtcattgaccttatcctttaactccagtatttcctttgaaccagaagttagatctagaacctggggaattcaaattaaatgttttgactacagtgcatcaaaggtgagacttccatataattgaacatctaaactggagtacttttgagaaaaagggggtattgttcataattacaccaggacaacagtgtaacaggacttttccaggtaaaccaagataatatgatcacccaaataattggtgatgttagatatttcaggttgtatcatatcagaagacacttaatatctagttaactcaccattagtattttttagtgatcattggatttgagtaacgacagtctcattcctccgttattcggttacattttccccttgtggctcaaataaaatctattgggtgtgagattcttaggcattatatgaatatctatttctcatcaactatttgcacaacagttttagcaaacaattgataatccttgccagaattaatagttctttttttgcatgtatgcttgtttttcttttaatctgtcactttgaagctcacagagtaattctaatagggtttgcataataatgtttttgattttctcttttacctgttgacattcttttatgaaaatagaggtttcataaatagggcctattttcattaccttgaaatacagtttctattaaaaagggagtataacttgattgttttgattattaatttttgaagtaagttgctcataaacgtatttttaatgttcaggcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggtatttaaaatttgcagttgtatgtgcatttgaaatatagtttgcattttccccatcttagacaaacttagttaaaaagaatatagaagttttaatactggctgcccttgtgattggtttgtgggtgtttggcctatagtcatgttatttcatttcttccgttgtgtgaacccattagcaaatacctgttagctttgtataatcagaccttaactagtgagttatttaattacagcttgacccattttaaaaggtagaaagtattctaatgtcatgttgaaaaacgtgaatttagtttttgatcagtaatatgtacattgagggccaggcgcagtggctcacacctgtaatcccagcactctgggaggccgaggcaggtggactgcctgaggccaggagttcaagaccagcctggccaacatggtgaaactctgcctctaccaaaaatacaaaaattagccgggtatggtggtatgagcctgtaatcccagttacttgggaggctgaggtattgcttgaacctgggaggtggaggttgcagtgagccgagatcatgccactgcacttcagcctggacaatagtaagtgactctgtctcaaaaaaataaaataaaataaaatgtacattggaaagaatgatagttaatatactatgtttaagacattacataatcttaattatttgttgagattttatattggcaaaaggtcagtatattacatggacataactaggtcaaagtagaggattttaatattatgagctttcttttttcccaataagttatctaatattttaattgttaaaatctttaaatattaaaagaaaatgaggtgatagttacaataaatgtattaagacttttggagaaggcttcccttgaggtatagattttaaatctcatagtaatattagtctgtaatggctacattgaactttttagccatttcaagtattagattagaaagttaaggaaatttagaataatgtacaaaataccatggttgataaatgtggaaaggccatgtgtattcctcccttaccactgccaccactattactaaaacaaacttatacctaaagaaaaaggtttcacagtggaaatgatttggtatatgtatttttgcatcttaaagccattttcataaatttttttaaatctaagaaaaaaataatagttgtactttttattttttaaataggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccatgtccatagccataattccaccatcatacagatcaggcagtgtttaaaatgatggtaggtagcacagtggacagtctttgatcatcatgtagaatatggctatgaatcaggaaagagattagaacatttaataatgtatgtacagctggtgcttagtttttttttaatctaaatttaattaccttattggatatttgatatttggttatttaatcacagtcatctttaacagcttacactgattggtgttttatctcctgtgatcctttgatggctttttttgcctaccatttcacagaggtttagacagcagtagtagctccctaggagagtttactgatgaaacagcctctgcaagattttaaaagttttgttcttttatagactgatttagaaaaacaaatgattagttaaaaaaagaaaatatacatttgttggtaactaatgttattttttaaaacctggaccttttctggaagggcagcatataaaaacatcagtcccgaggaggggacaacaatactacctcactactacatctgtgatgactggttgttcaaacacaatggagtgtgtaaggtatatgttttataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtgtgtgtactctgtgtgtgtatgagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaagaaaggttgcgtttaatatattttttgaactttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttgttaattttcctcattttgaattatgtgcactaccatagctacatcagtttgatacagtattgaaaaattatcagttatattttgctgtttatgatctatttgtagattaggattaaaatggatttaatccatttttaaggctgtgtgaatttttctaaacaagaaccatttgcaatatggatttcttagagattaaaccaattataacttattagcagtcgcgagcacatgttcatatagtcaatgtaaaaatacactaatgagtatttggtaaatcccagtaggcttttaccattagcataattttgtgttgtacaattaagttacaattacatctctaattttggataatattcattggttaacaataaagtgacaaaagctcatgccttcaaggtccactgttgttatttaacatggattttttgtatgtttcttgaaaattacaatctttatcacagccatgaatcaccacaacttaaaagtaagaagtagataggaaataattttaaatcctcatagatctactctttccccgatacctctttggtatggaagtaatagtgattaattctgtggaaaagttaaattattaaattaaattgactttgttgacaacaa

SEQ ID NO: 13340 - DNA, 255 bp, Homo sapiens
cttctctgtccagtcttgaactctgggctctcttggaactttcctcacccctctcagcctgaatattccttccatggattccactcaaccagactttggatctgtgcctacttaatcaaccttatctttgcaatatgttcgggcccaccttccactccttggttcttgtcctccttggcctaacttgtcccttctccactcacatccccggtgggacagcattcctccttcctcccaacctccctccttctcaaa

SEQ ID NO: 13341 - DNA, 255 bp, Homo sapiens; identical to SEQ ID NO: 13340

SEQ ID NO: 13342 - DNA, 306 bp, Homo sapiens
atgcagcccagctcgtcatgtggcatgaagtcagactgacacgggccctctgccccttctgggggtggctggattcttggcatcatttctgtgttgagctacatcccacacatccgttgatcactcaggtgagttcctctcaccaccctgggcagcagtgtgcagttggttacaaagctcttgtcttttgttctggattgaaagtccgcaaacatagcgtttatgctgttgaagctgtgaatcagaatttttattctgtttgttttgttttgttttgttttctctttacagaggtaatcaagttac

SEQ ID NO: 13343 - DNA, 306 bp, Homo sapiens; identical to SEQ ID NO: 13342

SEQ ID NO: 13344 - DNA, 16176 bp, Homo sapiens
cgacggagcctccggagaaaggcaagcacgtcgcagccaatgaggtgatagaaacgcaaagcagcgaccaatgactagctgagttgggctgggccggccgacgaatcacgaggcttcgcacccggatatggttatgggctcggaaatctagttcgggaaaagtgtgaggggctcttcacgtggggaaggaacagcaggcgcggaggagggggcaagcgtgtgtgagattcagtggtccatgcgtgcgtttgtcgtgtaagggtcattcctggggtttggagtgggggaacaaatcaatgtggctgtttttccgtggaaagaattcccactgcagtgtcccggagcctgcgtgtggtgggcaagctcctcaaatggtatctcacagggaataggggagtcttgaaaacgcagcttcggcagtaggaacatgaacctcttacctaaaagttccagggagtttggctccgttgactattgggagaagttcttccagcagcgaggaaagaaagctttcgagtggtatggaacctacctggaactgtgcggggtgctacataaatatatcaagcccagggaaaaggtgaggagcgcgggttggtagcccttcgtacgtgctccggaaggtgggaactggtaacaggaatcttgcacttggtggacagtgacaggcgggaggaccctagttggacgcatatttcagcatttcctgcattgttcctgctaaaagacaaactagaatattctttcaggccgggcgcagtggctcacacctgtaatccgaacactttgggagaccgaggtgggaggatcgcttgagccctggagttaaagaccagcctggggaacatgagacctcgtctctacaaaaaatgaaaaaattagccgggcgtggtggcgcgcatctgtatttccagctactcgggaggcttaggcgggaggatcgcttgagcccaggaggtcgaggctgcagtgagccatgatcacgccactgcactccagcctgggtgacagagtgagaccctgtctaaaaaaaaaaacatttctttaaaggttttcagataatagacctcccaccccagctcattcttggattaataaccctacttgaagagtgacttcccatcttgaaagtatgttcttctgtcactgtgcattcctgtgcaacctgcagcaggtgtgactttgtgtatgaatttgtttttcaaatagtcgttgagtgcgccccaagtttcaggcactgctcagtccttaaactataagagcattaagacgtaaaccctgcacatgttccagaagtgaaacgtgataagtacaacaatgggtttggtataggtgagattgtactggaggtagggaaggaggaaggtagaaaacttaacatttgtggggaagctttatgtgccaagccttatgttgggtgctgtgtatgtgcatgtgcaatctttgaattctcatcataaattcaggtgagtggccatgcatacattttacagatgaggaaactgaggccccgagagccacttttttttttttttttgcccaagatcatgtccaggtggtcatgtggggatttaaactcaggcctgtctggctccagagcatatgcacatctctttgtaccatgcttttccaaagatggcaatatcagaatttctaagtttgaatgggagattgctccctggagagggagacaacaatctgaattttaagttcggcttcagaagatagccaaatatcatgagatggaatccgtgatggaagtaagatttgaatcctcacaaagtgtactttattgtctaaaggagccaaaggcatgagtagagtgaggaaatagggttattcctggcctaggatttcaactgtaactctatatttggattctctgacttcctattaattcctgagtaataagtgcatgatttagagaaaagaacagttatgattaatttgtttctgcaacacaaagcccattctcatataacctgtattgtagctgaatgtggttttcactagcaagtatatgtggtgtttcaagatagagtctagcatcaactctacaatgtcgctctttctctggcagtagcgtctccaccttctgaaaatgtgactcagccaaggtgagacttgattccttgaagtacctgaagtacagtcctttgctttgattacctccctcttgtctgtgaattttttctccaggtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggtgagggtgcaccaagtggccaacagccaggaccaggtgttggaagcagagcctcagttctccttgcctgtctttgccttcatcatgaccaagttcaggccagtccctggctctgcccttcagatctttgagctgtgtgctcaggagcagcgcaagcctgtgcggctggagagtgccgagcggctggccgaggcggtgcaggagcgacagcagtatgcctggctgtgcagccagctgcgccgcaaggccaggctggggagtgtgtctctggacttgtgcgatggggacacgggggagccacgctacaccctccacgtggtggacagccccactgtgaaaccatcgcgggacaatcattttgcgattttcatcagtgagttgggattgctccctctcttccctggaggggctggcttacaggggctggggcttgggctggggctggggctgaggctgggctggggctttggtgggattctggactgttttttgtcttgcaggggtttgtacttccagaggattagactacccaaggcatgatgaaaggagagtaatagctctctagcaacctacttggagttgagacctattccttttcatctgccattgcaaaggcttgatgaagtgtgagaatggggttggtagggaagagagagaatagagataaatttaggaggtcacatatgatatagagatgctagttactttgtagcatggagtaatggaagtaatgctggactagcaagtctaagacataggttctagtcccagctgtagcctgtgagctgcaggacctggggaagttgctgtgcttctctgcaaaatttggagaggcagcatagggtagcagctaaaaaagtgagctctggaaccagactgtttgggtttcagttttggctcagtcatttcctgatggtgtgacattagacaggttacttttctttctctgccttgatgggattgtaactctggtgtagttgtgagaagtataaaagctcttagaaatggtacctggccttggaagtgctgtgtaaatgttagccattattactgaaagcagtaagttatatcagatttatcttaataaggataaaaaagatagtaggaggaagtgctttcaaaagtggaacattgtagacaaatgcaaagtgtttatggtcttggtgttacggtaatttgtttcctggtgactgagctagtttttcaagtattctataattctgtctgtccatgtgtggaaataaatagtgcagtgaatacaagcgtgggtagagtctggggctagactgcctgggtttgagtcccagcttcaccatttacttattgtgcgaagttgggcaaatagtgtaacttctgtttctcagtttcctcatatgtaaaaatgggaataatactactacctgcatcttggactgttggaggattccattaatatatatttgtcaacagcttggagtcatgcctggcatggcttatttgtgttggcattactgctgtttttcttgtggtaggtgtctgcctccttcccctacggacatgcccacacttcttctccacccttggtcctgccttatgtctgatgggctgctttgccctagatgttgtgaactagagaattgttagctcctcagtgggtcacagttggggaagatgctggtcttggacagggactggctccctgccgtttgggccatattggttgtgggcttgatcactttccaggactccctgtaaccaagttcttttttctagtccctcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtaacaaagctttcgtacggctttcatgggtctctgaagtcatgttagcagccagggaggcagagggagccttggcaggagctaggactagagtctgtgactcttcatctaatcctggaggggtatcagcagctaagggttaaatggcagggaaactgtcctttgccccaggcaatgagaggaaagtgagcacagtagcgtctgtgtctgggggagcctctcagagtccatagacatggcaggatggaaatgctctactcattgcgggcttcagttcttcctaatttgagttgctctgactgtggatttctccttccacactggactttcttggtcattttgcttcttagaactatcattatctgagggtataaatggaagagggccaaaacagctcagcacagttatccaggtattcacattgctggtcaggtgttttactgggaaggaaaccgaaggtttttgcctaagtggtgatatggtattatcagttaacaccaactgtcttgtgctatcctggtcaccatgggtaacgaacaagtgattttactaaaagaacttcatgatgaggagttgatccttttttttcttttttgagatagggtcttgctctgttgcccaggctggactggagttcagtggtgtgatcacggctcactgcagcctcagcctcaacctcctgggttcaaaccatcctcccacctcagcctttggtagtagctgggactataggtgcaagccaccatacctggctagttttttttttacattttttgtagagacagggtctccctatgttgcccaagctttgatccttcttgataggtgggaaagcaaaggtatctagaggcttggtgcaaatagtaacagatctgaaaaaaaagaacccaggctcctgggttcctggcctgtggttttgcccactaggctgactcgtgtttacagatgaatgtaagtttgattcttcctggccaactttggggttgatgacccctatttcaaggaagcccagatcctctgaggagcttcatttgtggcctctcaccagtgcctgagtctgcagggtcaggagatattggtgattattaactagtcttataggtctttaaaaaaagaaataaagatagggggaaggagtgggaaagtttagggggaaagtatatttttctcctaaggttcagaaaagtgggggaaaaatagatgagaataatcaggggaaaggaatatctctctagatttggagtggttgtttctcccatggattttgttatctttattcttgtgtagattccttctcataatcacagccccttcctgagggttccctctagcttttgttatcctggactattgagagttcttttaggggttactgatgagaaaaacccctaaaagaacttggggagaatcagctgcatctcactagttgtttgggagatctttatgtgtccagttgattttcaaaagatgaattaaacctttgagatcagttcaaaggctccagaaaagtactttaatagaatggcaaatctgtggagtagttgttgtctagaaccgtggtatggggatatatacacacaaaagggaaggggttataatttctcttatttcttaaatgagctgctgttttgaccacatctctggttgtaccttcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaaggtgaggtgtcataggcacagtggtgggacccaagtggccgtggcatggactagatttcttgggagcttggccgagatgtaggatggacctgggtgtctgtaggttcttaaccatctggactcttagggtgtgaatagctataagcagagtacattctgttcttgagcagagcctggctctgaagtgataggggacgtgagtagtgaaaccaaatacagtgataatcacattaatgtcttcggtttaaaggcatctgttttgcaggtgctccatatacatctgtgtattgtttcaataggcctctgtgaggtgagccagaactatggaagttgcaggtgagccctgccctccatagtgtgactcacctgtttcagagggttttggattggcgggtgacttagaggccttctagtataccactgttcagtaaaactgcctgtgatgaaggagatgtttagttcctgagtttctaatgtggtcgcgactagccatatgtagtgctgagcgtttggaatgtggctagtgtaactgaggaactgaattttaattttctttaattctaattaatttacatttatatttcaacagccatagggggctagtggctagtattggacagtgtagatctaaaccatctcttctaggatccctttaagtggtctcccagctgtcactcagaaactcccccgatggggaatcaatagtttgttttacctgtgttagtttgtattttaaaagtgatacttgttcattgaaatcacttcaaaagtcaaatatagaccgcgaaaagtgaatgcccctcacctctccgtctccagtgcatcttccctgtctgaggcgcagagattcaaggatggaagctgaaatggctctcctgattcccagttgttccctttgcctgactggcctgccctcatagcaaggccatctgggaggagggtggagacagagaattcagatgcttgaggtcatagactggctctgagcctagaatcaagttacccagcgaaatggtatttttctttaggggttttccctggccaagagcacccaagattgttgggtttctgccctattgtttggtcactgtggctgcaggttggtccagtttcatctcactaaaatctcagtaaaattgcttaaaagaacattttgcccctttcagtttgggtttcaggttttttcaccattgtcatgttccttgatttcttggtagcactttgttctcatggaaagaacgttctccctcatgggagtattggtgagcaagaaggagagcatattaaaaagtgatttaatatatctgaaaagcaccccgactccactcatcagcactttttactgctggggaatgcagctgatccctatgaagacacagccatccgtttagtatgataccctggagcagggaagggagtggtgagagggaaagtggagtggctttttaggatttatttccttttttgaatacttgtgatttccttcttcagcaaaggttggtagtgctacctgtgtggcatagcagaaagatgataggtgatggagacaggcagtccgaggatcaactcctatctctaccatctgctgattccctatttacttaacacttcagtggcttagtgtgttcatgtgccaagaattggaatgataaggttgttagaagagctaaaaaaataaaagttacggtatagtaattggcacatagcaggtgattagtaactttacctttctttaaaagactttatgagtaatcttttctcctgttagtggccttacatttcttagacgggaggtaccagggctcctcagttgagttttcccaggtttttgagtgtgcatttgccatttccttttccagcttccttgtatccattgtatatgttaaatgtttaatgactatgtctttgtggggcggggtagggggggcacatcctaatttatagtgtttatcagttctctagtataaataccaccactgtatttgtttgttttacgttgcttataaaggaatacctgagactggataatttgtaaagaaaagacttttattttggcttatggttctgcagactgtacaagaagcatggtaccaacttctgcatttggtgaggcttcaggaagcttacaattatcacagaaggtgaagggagaccaggtacatcacatagcaagagagggagcaaaagagatgccaggcttttttcaacaacagctctagagtgagaactcactcaataccatggggaaggcacccagccattcatgagggatctgcccccgtgaccagcatggtggctccgacattggggatcacatttcaacgtgagatttgtaggggacaaacatccagatgatttcactacggccagtttcaagctatcaacatgatgtcaaccagtttgcaaaattttaacgattgggtcttttgagtgttcaagccatctggagcacactgctgccagtaacccttgcttcctgaggactagtgtactaagcatagggcttcatatctcttgtttagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctaggtgagagagatgccactgccttccacagaagggagcataaagattacagacctaaacaattggtgtcacttgcattgtagttgaagaacagcaattacaagctgacaatgtatctttcttcatctcaaccatgttataagttaatgagcattctaattaactgttgcctcaaactcaacctgttatattgaaattgtattgaaatatgttagagtctaagtggtattttttctgttcatttctttttaaaattaaggtatatcatgtattcaatgagatatgtaaaaatacacagattttaattgttcagcttttctgtaatgcattatttgaacaaaagatgcaattctatcttgaatttctactttctgaaaagattcatattatagttaatgcagtcatagccttatcgctaatagcaggtttggatctgactgcattagtgaaattgttcatgttttgtctgtgattgtaaccgttttcacctgaagtccctgaatgtgccttcttggaataccctatacttttgtcctatcttagtgttgatgtatgtcactagaatctcagttcttagatttaattctcagggtctgtctccttcgggtgacttttgttgtcttcctttgatccccctgtggtggctgtgctctgtgcttaggagtaggagttgggcctttgttttcctgtgatttgtggaacttgaatggcttacccttacttggtgagggtgtctgagaagacggtgtggccttttgagtcaagggcaagggacattgcacctctgctgccttgtaatcatgagcaagattgtttggccactcttcttccctttcctagagagggtctaataattcttatagtgaagaagtctttttttttgagacagggatttactcttgcccaggctggagtgcagtggtatgatcgcagcttactgcagccttgacctccttaggctcccacgtcagcttaccgtgtagctggtaccacaggtgtgtgtcaccatgcccagttaatttttctactttctatagacaggattttgccatgttgcccaggctggtctcgaactcctgagctcaagtaatctgcccacctcggcctcccaaagtgctgggattacaggtgtgagccactgcccctggccactttgagatctttaagagacaataataataacacactagttcatcttctggatctagtcatcatgaatccaggattcagttatcagatgtcaaattcactcctagatttctgaaatgagacagggagacctctaaatcttgtatcccctgaatggagacagtgagctgactttcccttttgccttccctgaggctggtacagaattttccagtgaacaggtggcaatgtgatgctctattcttttcttacagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaaggtactgctcttggagcatttgaaggggtgttgagggatgattgatgcgacattgtcaggcccgcaagggcctctacagtttatctctaagagagtggcatgagtatcgttccagtcttcagcctgttcatttgttgatatacttattcactagagtaccagctatatgcttagcactgtgttaggtgtgaatgtaaagcaataagtaaaacaggccattcctgcccttatggtgctaacagaccagtgggcttttttctgacctgtaaccttgtcatttcctcaccatcttaagaaacctgaagtctaactgggcaaagaaacagagaagaaaaggtggaatgtgtgttgggaggtatttttgtaaatatttcaactggaggtaaagccagaaatagagcaaaacagtattcatgtaagatcagtggtatacaacctcagggtctgacatttggtaatgtatggagacaatttttcattgtcacaaatcggggtgggggatgttgctactgacatctaaacggtagaggtctaggatgctagtaaacatcttacaatgttcaggacgggcactgatgacagaattatctggcccagaatttccacagtgctcaggtggagaaaccttgatgcagatggtactctgtgggaattttgataggccttctgcaactagaattaaggttccatttgctctagtaatttgcatcccagatttaggacaaaaaccataagcataataattttctgtaaaatactagggacagtaactctgctattatacagataggctgctggtgagtttagtactttctggagctcgagtccttcggggagaaggcagttaggttggttcagttctgttcaggactgctggtctgctcattccataacagatactctggtctcactagattagaatattttccagtaagggtgtggcaaactaggaggcctgggacaagtattgaacagatgctatcttaattttaattgcaaactgaattgaattgtaacagtttcgtaggttccctctctgaggctagggttagtttaggtgcccaagcccagatagctaatacggtgaagtatttacaacagtgccatgcacatggtaagtacttaatccatgatgttactgctgttgttatctatagatcagttttcaatggctctgcccatcttctgtaacaccaaaatgtttcagattactggagggctcaaggctgcaaatgcaggctattgttttccttggactttgatgagccaacatgttctctttgtaagaaaccaaaatcagatctgtgctatgaacaatgataagcatgcagcagtcctaattaaatacttattaattattgaataattatgaccacagtctcaaaattttctaaaaacctgtcagtggcattgcagacctaccccttataaaaacaatttaacattatagtaaggagcagatccatttcttcatcagttctttctcacccatttagcaaaatcatttctttcttgagtcagctcttgttcatggaactgcaaagataacactaactgaaatttcagaacattttctcctatgaggcaaaatgtgctgttttcagagttaaaagttaccatttgctgggtcagcccttaaaggcttagtcagctgctttgtctagatcagtggttctcaactctgactgtatttagaattacctggaaagctcaagaaaaataccagaggcttcccatctctcctcccatctgccccctactaccccaggatattttattctgttggttggcgtgtagtacacattagaagcttcccaaggtgattgtaatgttctgccacagtcaaaagccactggtgttgatagactcttaaccgagaaatattcatgcaaaggggaccccagtaatgtttttgcctttggaaggtgcttttaaatgtggaagaaggttccatctttactatgggacactctgaaccctgatgacaaagactcccctgggccatgacatcagtgcccttacaggcaaaccacatcctctgtgtcatccttctaacttagtcaccatgcccaccactggtaaagaggaggtatagtgttggaatgtaaatggtattattttatccagcaaagacaaggacttgtttccttctttttcccagcacggccttgctacgatgtcataatgtttgatgttgacagtaaggacccaacactgggaatgagttgtccgcccccagcatttgtggagcaatcttttctacagaaggttaaaagcatcttgactcctgaaggtatggagaacaaaaggtgggagagggaggagagaagggaccattaacaaaaattatctttttaatgaaaaatgcacagaagtgcgagctcgatcaatttttccaaatttaatacacccatttactagcactagacacagaaaatttccagcttgccagaaagtcgtatctcttatcccctttcagtaacttgtcctcgcaagagtaatcactgtcttaacatttgtccacccagcttaattttgcctgttcttgttctttatataaatggaatcatatggaatgttggaatgttcccttttttttttttgagacagggttttgctttgtttcccaggctggagtgcagtggcctgatcatggctcactgtagcctcaaactcctggtctcaaggaatcctcccacctcagtcacctgagtagctgggactacaggtggatgccaccatgcctggctaatttttttatttttattttttgtagagataggatctcaacatgttgcccaggctggtctcaaactcctagcctcaagcgatcctcctaccttggcctcccaaagtgctgggattacaggcatgagccactgaacttggctgaatgtactctttaagtgtccattttctttcactcaacatgatgtttgtgagactcattcacagtgttgtgtttacatggcttatttttattgctgtgttatatcatgtaacttaacacaattcgcttatccattctactgttcgtatttggtttgtttcctgtgtgggtctattataagtggtgctgccattaacattctagtatatgccttttgatgaattatgttttcagatctcttgggtatatacacagggttgtaattgctggatcataggttatgggtatgtttttggcttttgtagatgctaccacacagttttacaaagtggttgtagcagttcacactcccaccagcatggtgatgctagctactacatgatgcttcctacacgtgctctactaggcagtgtgttatttaatcttcatagcagtccactttttggatgaggaaactgaggttgaagatttgccaaggtgacgcaaggtaacagttggggctcaaagtcagtgccttgtcacctcaaaactggagcctttaatccctatgttaacaaccctctaggtatttttgatttggtgtaaggcactgtggtaactggcttgatttggaatcttaattgtcagaagtcaagataacctcggccctgtcactggttaatactctatggtgtgtatgccaagaatgtaatatccctgtggagttggtaaattttactttcgtagggaatcactttctattgattgattgagacaaagtctcattccgtcacccaggctggattttggctcactgcaacctctgcctcctgggttcaagagattctcctgcctcagccccactagcagctcctgcctcagcctccctagcagctgggattacaggcgtccaccaccatgcccagctaatttttatatttttagtagagccggggtttcaccattttggccaggctggtctcaaactcctgacttcgagtgatccgcctgcctcagcctcccaaagtgatgggatcatagacatgagccaccgtgcccagctgggaatcacttctttctcaaagctattctttgagaagctatttgggaaactgaggcttggagaatggtaaaataacatgtgagcagcacagaagagcaagaaataaggctggagtttgtttatggctcacatgctccccatgcttttctccatctgcctttctatgctgtgtattctctgcaaactcatcaccaccgtgtgttttagtccaccagtctccctgggacaggaattggtattttcctcaaagccgatccttgtctttcatatgtctcctgatgtgaggtcattctgacttttcttcctaccctataggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccatcttgtcctcttcagtaccacttgggttggtttgtctttgcttcctacaccacgtccttgagtggagttccctgctgaagcccctagcacacactgcatgccttaacaagtgtgtgcaagcccctcagaactcaagacatccaaattttattgcgtctctacttatactggtttgcttttgatttattcctctattagttctataggagtgatctcaagtgagatagcagagcaagatgccaaaagaccataaatagagtaaggtttctatagatgtgagacagatttgagagagcatttactctgtctccctgtggatgaaactgctgctgaaatggttccaatttttaggaatctgcttacccacttcattatttgacagctttccttggtgacccaaaccttgtagcctaagccatttgtctttttctcagtggagggagtgtatggacctggccccatggctttgcatgttagagacctggcagactaaagtctctagtgtttgtttgctcacatttgctgagtgacagctatgtgccagactgcataaagggtggtggcagaagtgaaaatgtttaagaatgaccaaaaacattagtaatgaaagttaatgtgttccaggcattcttctaagtggtttacatgcactgtctcatttaatctgagataaaggatacttaagcccaaactatatctaaacccaaatctcacttggctggaaacatcaatcttaaccatttattcagaaccattaaaccaatgattccaaga

SEQ ID NO: 13345 - DNA, 403 bp, Homo sapiens
agcctgcttactcaaaccctagtctgactcccctctggagcttgctggattgtgaggaaagtggtgtgtgtacagacagccattggcctgaatcccatcttttccactggagagcttttcacttttgccttaatgacaagcaaatggttccttatgggaattttgcctaactttaggggtgagcgctctagaggaggggggagggttagaagcttcaatgcctaccagaccaagcaagtaacaaatatgtggagtgagtgagccaggtataaaacaaaaaggctaggatgagacctgtggcaaaccagagaataaatatcccctctaaaggcagcggctgtcccagctgagctgtcttgcaggagcactgtcttagcatagctaggtctttaagagaagccag

SEQ ID NO: 13346 - DNA, 4628 bp, Homo sapiens
tccgtggtttcctctgtcacttttaattaagacacaagttgagtaagcagcctccacaggctgtattcccaggcccccgcccaccctgacctttggcccagaagctactgcttcagtgtgtggggtggaggagtgagactgggtccacagtgacattattgctgacctcttctgtgtgaggaaaaaggccacgagaccctttgtggggccagccctgagtgctcctctcccaagttttaaggcagggagggggaaataactgtacagcccttttagcccccagctctggagtggcagacagcaatgaggccacatccctggagctgcccgggggaagtgggtgaggaaccaaagccgtggtccctgtagagcagctgtggggaggggagggccagtcccctgctcagtcctgaccacataagccttggtcacaggtgtaggtggagagggcactgacggacactgccctaaggtgcagtcctgaggcacttaggtgggcgcctatctaggccatgcttctcagttggccttgaccttggcaatacctggagctccattttgctgaagtgcacggggcagccgcttgcccttggtataagagtgataccagaagttggagaacagcatgaagaagatggtgccatacatccagatgaggtgaataatgactgggtactggtagttacagctggacataaagtagtactgggagatgtgcagtgagaccaggacaaactggatctaggatagagaaagaccagggtcagagggaatagtgagaggactagaggggaagagggggtagagaaagagacaaacgttgagtagggagagatggggtcaaaggtgagacagactggataaaggcaggatccaggctaggaatgtggggggatggttataggtaagtcaggccaagcccctcaccagctgaatggctgtcatgtgctttttccaccaaaggtagggttgtgccacagggccaaaggcagataatccgtagtacaggtacattatgacatgcacggaagagtttatcatggcatggaaagagcccattcctcctgtgagtggacaataagacagggtcagcagagtccagcctctggtgcccaccctttcccatagtggccttcaccactcacccggggcaatctttaccccccaccaccagctccagggaagcacagagtgatggaagacatgtaggaaggtcacctgcccgtctttctttcggagaataaagatcacctgagagaagagtgagggaaggggattcagaacctgggcttctccacctcattctcccctcaagttctcacatctcatataactactcactgtgtccatcagctcaatgaacttggagaagaggaagagccaggccacccgaaccatctgcaagaagttgggatagccttaggacctcatacactattctaagagcctccctaaactgggccttgagcacaggccccaaactggtcatatctaccaggttgcttatgacctagccccagcccctacttaccctaagtgcctcagggctgttggaatagtccacagggtcacagcgccaggtataggtgctcagccagcccgacatcaggaactgggaagggatgtggattagaccaccagagttctcccttcccagccatccctccccttcgctagctgaggacatggatctgaacctctctggaaaggagaaatgccatgctctggctctatggcctgctccttatcctgctgacagaaattaaagcccggcatcccaggggcccacctcatagacaatgtagagggagagtgccaccagtgagaagttgtagacaatcatgaagccacggagctggaagggcttccgattagccatgatgcgaggcccaagtgagagaacgaagtacacgtaggtcaggagaatggaggtcattagcaagggggaccccatcagagggtagccctggatccggggatctatgaataagggtcaaaggaatcaggaagagtcacagggttcgaagggtcttcatttgaagggtctacagacatgaggtcaggtcacaggatcaagggtttcataggaactctccattagaagacagccgtagatccagggatcccgggaaagaaggaaggaaagggctggtggatagcgtcttacctgcgtgcttcatcacctcttggtacaagttcacaacagcctccatcctggctaaggactctggggaggtacagagggcggatgtcagacagatcccactgcacacccccatcccacagagataagacacagaaccagacaagacacctgcaatgcctcattgcagaaaggacagaacagtgaaaggaaggaattactgggaactagggggaggaggcagtttggttgaggcatctgctccccacacatcctgcttgcctgggaagagctgttccacccttcctctccacaccttactctcctctcctctccacagttttacttcctggcctcccttcccctcttcctccacaagataactctcaattccaggtctcttactggagaatcttaccttctcaccaacagggagctcttgaactccgtctcccttcctcacccgagtccctcacctccccagctctgggtctttcttctctccagggattctccccttcaatctctcctctcctgccctctcctcttcccatccctctggacccttcctgaactctcttctccccagggtccctcctgtccctgccaggactctcacctctctgggcccttctgtccctccagaaccttatcctcggattcctccttgcctgtgctgggacacttatgtccctacgattctcctctgcctttcctgggactctcacctccagcctctcctctccagcgctctcctctctcctctcgcagagcccttcctctcctggagcctggctctttgagactcctgccccggcggctccacctgtctgactagatctggcagcagccccgccctctgcccgcccctgctgtactgtgcagggggtggagggtgggtccgggccacaggtcagtgcctgggggagcaggacccaccaggattgggaaagccaagtaaagccccagactcgccacccacccacccacgtgggaccagcctgatgagctaaggtcctagattctgagccagaaacctcctctgaccccagccccagccccagccctggcccaaagcactgctgaaaatccacacccagcatcctctcctaagccggccataactgctcagtttgtcctacttcagaatgggtacaatcactcttcccttcctgggaagggcagggaagccagtggcatgtgaaggggttggggagtgggggaggtcgcaggaatcttcccctccctcagggaggggccccgttgggctaggccccctccccctcagggcctgaaggaatgtcgggggaaggctcccagggacacaaaagcctctggccagacccaggagagcatggtactgacagtccctgagggacaaggcattcttggaacagagcagggcccagggcagcaggtgccccagactccctgcttccagagaagcacctctgcagatgccaagtgaagaggcgcacctctgacacctccctgccccgcacacccctcacctccaggaggcccggcttctttaggcccaccgtggtcaggccccaagcctgcggtccacacccacctctcacctagctctccacccccaacagcgaaggtgccacgccgagggctggcacacacgtctcctgcctgacacaccacgcaacacctccgtgggctgacacgcatggctcccggccctcacgcagctcggccaccgcccaggcacacgcacgggctcacccgcggggccactcacacacgtgtgcgcgctgcctggccacgctcggatcccctccttacttgctcccccaccatcgggcttgctggccgcccatcgccggcagggcccaggccggggcgagggcgccaacacaggttcctccctgacacatgggagccagccagcctgttatctctcaaccaccagcccccaatatcaacccacacacccggcaggccaggagggaccaaggctcctgggaggacctctccccaagctgcaggaaaatctgggtgtgtctctcgtcggggaactcagcccgtcccttccttcctttaagatggatggaagggaaaaggtgcctggcaaagttagggtagcggggggagggaggggagaggaggagggagagaggtaaatgcaggggtggtggaggaaggcccgggtgtaggcaaatgggggccagagacgggggtgtgggggagggagggtgctggcgaggcccggccccagggagctgggacctcccacccactggccccgggaacaccctcgcccacagcctgggcagggcagggcagggctgggccgggctgggccgggctggccaggcagggggcgccggcacgtggagagtccgtggaaggtccagactcacccgtaggggccaggcgggcaacggcggagcgctcggagggagcagggccagagagaagtccccggggccagcctgcctgcctgccacttcctcatctgctgggccgactt

SEQ ID NO: 13347 - DNA, 4447 bp, Homo sapiens
cgcgctccgccgctagactctcgtgatagctgagactttccccggaaggcccgcccccttcgccggagaggccaatgggctagggcaacggttgcgacggttggattttgaaggagccaataggcgctcggagcggagagtttaagaggcgtaagccaggcgtgttaaagccggtcggaactgctccggagggcacggtgagaggtggtggggctgagccgaggtggggccgtggccagggggagggggtgctaggccggaaggggctgcagccgagggtggccctgattttgtggccggccaggagcgaaggggtccctttctgtcccctgagcaccgtcgcctcctttcctccagggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggtcagtgaggtgccaaaggaactgagtgagagcagccttcatactttctccctggggagcctggtcagactgtcttctctttctccgccccaggcaaatccagttccaaggttcagaccactcctagcaaacctggcggtgaccgctatatcccccatcgcagtgctgcccagatggaggtggccagcttcctcctgagcaaggagaaccagcctgaaaacagccagacgcccaccaagaaggtatgtgtcccagaggggcttaaggcacgggacctgactgttctttggataataccatcttgctccttcactaccctttatgccaggaacatcagaaagcctgggctttgaacctgaacggttttgatgtagaggaagccaagatccttcggctcagtggaaaaccacaaaatgcgccagagggtaagacccgaagttcctggttcctggagggaggtgtcagttcatctccagggctgagcacagatatctgtctcctcttcctatctaagattgagggcaagggaggtgttgattttcccagcgtctagactcactccgttgccacaggttatcagaacagactgaaagtactctacagccaaaaggccactcctggctccagccggaagacctgccgttacattccttccctgccagaccgtatcctggatgcgcctgaaatccgaaatgactattgtaagtgcatccttatcctcgcctcatgcatggagaaagagggcctgggaccacacaaacaaggaagctcatgctcttctctccacctctgacagacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcaggtgagacgtgtccagtgctgtcattctcaccagtcccaatgggcttgcacagctggaggatattaatgccaagtcccaatctctgatcctagtgggcttctctctctagctatgggatgtgcagcagcagaaacggcttcgaaatatgaccagtcactctgcccgagtgggctccctaagctggaacagctatatcctgtccaggtcagtggtttttgttggtctatggtagtctgatatttgcccaccctccccttgactgtacacccctgaactgaaccagctctggcttgcttgcatttggtgctgccacagaacctgattcccttctttcctcctccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggtgagtagggttgggctgaagcctctgcagaccctcacctataatctggggactgttaaggggagaagggatggtaggattggactgggttaatctgtgacccctagagctccttgtctggctctagtacctgctgaccccacctttattccatctaggccgtagcatggtgtccctggcagtccaatgtcctggcaacaggagggggcaccagtgatcgacacattcgcatctggaatgtgtgctctggggcctgtctgagtgccgtggatgcccattcccaggtaatcttttgcctgttcctgcctctcccacatgcattcttaccgggcaactacattcactccaatggcttcaccaactctatgccctggtgattcccaaacttctaactcagctctcactcatgagcttcatttccaacagtctgtggctatctccaatcctatgtcctataggcaccaccaccttgatctgtcccaaattaaccttgtcacttccccttgcctccctgaaatgtgttccttcctgtctcacattgctttggaatggcagaacctgctcagaaatctgagaaacctcctagaatttttcatcctcctcaccaggatctatcagttttacctcaaaatatcattgacatctgtcccctcccctcagcctcatccttccaagtggaggcccactacaatggcttcctcactggtgtcaagcattctttgttatctcctgcaatgcatcctccatgctgtggtctgttatactgtactgtccttaaacctgtgatggcttcccatcacttatggcatataatccaaatccattagaaagatacttgaggctctctccttccactccccccacattcagccttcactgtagatatggactctagagccagatggcccaagttaaaattctggctctgtcatctactaaacttgaatgtgacctttggcaacctattgaacttccttctgattgattcctcatctatccaatggataatacagatgctccctgatttaagtcccagtaaacccactgtaaaggtaaaaaatggttacatcagcgagtgtctataatttgcctctcaaggaacttttgtatggactatgatcattcaactctgagtctggagcatgtggcagggtgcctaacactagaatgggctcagttctgatttaagtagccttggctatatgtcatgcccacaccagctcctctccacaggtgtgctccatcctctggtctccccattacaaggagctcatctcaggccatggctttgcacagaaccagctagttatttggaagtacccaaccatggccaaggtggctgaactcaaaggtaagtggctaggtgaaaagccggacataaaaggccacataatgtatgactgaaatgtccagaataagcaaatccagagaaaaaacacattaatggttgccaggggctgagagagggtaatgggaaatgttgaaaatgtcttagaattagttttaacagttgtacaattttgtgaatatactaaaaatcactaaactgtacactttaaaaggatgcattttatggtgtgtgaattatatctcagtaacaccattgaaaaaaaagggaggaggccaggcacggtggctcacgcctgtaatcccagcactttgggaggctgaggcgggcagatcatgaggtcaggagatagagacaatcctggctaacatggtgaagccctgtctctactaaaaaacacaaaaaattagccaggcgtggtggcaagcacctgtagtcccagctactcgggaggctgaggcaggaaaatggcatgaacccaggaggcggagcttgcagtgagccaagattgcgccactgcactccagcctgggtgacagagcaagtctcaaaaaaaacaaaaaggtaggtgggtggcccagtgcctcctttatggctatggctgcatcagcattcgtatgtactgttctcatttgctccaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaatctgtttcagctaatgcctttcttctttcatgacctatgtcccagcagccttc

SEQ ID NO: 13348 - DNA, 166 bp, Homo sapiens
gccgggcgcggtggctcacgcctgtaatcccagcactttgggaggccaaggcaggcggatcacgaggtcaggagatcgagaccatcctggctaacacggtgaaaccccatctctactaaaaatacaaaaaattagccgggcgtggtggcgggcgtctgtagtccca

SEQ ID NO: 13349 - DNA, 1082 bp, Homo sapiens
cttggcctcgcaaagtgctgggagtataggcatgagccaccactcctggccaggacagcatattttggaaattcacctatgttgcatgtgtcaatagttaattcctttgtattcctgagtagtattccattttgtggaaatactacgatttatgtacgggttgagtatctgttatctgaaatgcttggggccagaagtattttggactttttttttattttggaatacttctatttgcattttaccggttgaacatcccaaatctgaaatatccaaaatccaaaatgttccagtgagcctgaattcatctgttgatgggcatttgagttatttccggtttgaggctattatgagggaagctgctgtacatgtgtttgtatatgttaaatgtgttttcacttgtcagattttaaaagatttaacagatttttaaagtgaaaattgttttaatgatggtatgcttatttagactattaggaatttaaaaaattatcatttaagattcattccaggtcctgcattgattttattgggtcacaataatagtgtccatttgaagatatttcaattttttcagcaccgtcaatttcacttctagctgctatcagtataccttctgtaatatctagcttctgatttctcctttcatgagttagaaagcaggagaattgtgattatggattaatgagtcccttaatttgaggtcttaagataaatggaatttaagacttaggccaactgctattttgtagctctaagacacatttttgcttctgatttctatgaacatatcttatatgttgaacttcaaatatctcttacaagaataggaagcacaatggtgtatttgatcattgtgatcagtaaatacacaggatgtagcttctagatggtagcccattaaattatagtatttaaaattattatcaacttttatcttgctgaattttctgtgttaggtttttcttaatttcttattatatattacttagagtggattataaattgtcttgtggcttattctagtcacaggagtttgggggaaggctctacacaatacttcctaaaaagaaaaaaaagaa

SEQ ID NO: 13350 - DNA, 8022 bp, Homo sapiens
cttggcctcgcaaagtgctgggagtataggcatgagccaccactcctggccaggacagcatattttggaaattcacctatgttgcatgtgtcaatagttaattcctttgtattcctgagtagtattccattttgtggaaatactacgatttatgtacgggttgagtatctgttatctgaaatgcttggggccagaagtattttggactttttttttattttggaatacttctatttgcattttaccggttgaacatcccaaatctgaaatatccaaaatccaaaatgttccagtgagcctgaattcatctgttgatgggcatttgagttatttccggtttgaggctattatgagggaagctgctgtacatgtgtttgtatatgttaaatgtgttttcacttgtcagattttaaaagatttaacagatttttaaagtgaaaattgttttaatgatggtatgcttatttagactattaggaatttaaaaaattatcatttaagattcattccaggtcctgcattgattttattgggtcacaataatagtgtccatttgaagatatttcaattttttcagcaccgtcaatttcacttctagctgctatcagtataccttctgtaatatctagcttctgatttctcctttcatgagttagaaagcaggagaattgtgattatggattaatgagtcccttaatttgaggtcttaagataaatggaatttaagacttaggccaactgctattttgtagctctaagacacatttttgcttctgatttctatgaacatatcttatatgttgaacttcaaatatctcttacaagaataggaagcacaatggtgtatttgatcattgtgatcagtaaatacacaggatgtagcttctagatggtagcccattaaattatagtatttaaaattattatcaacttttatcttgctgaattttctgtgttaggtttttcttaatttcttattatatattacttagagtggattataaattgtcttgtggcttattctagtcacaggagtttgggggaaggctctacacaatacttcctaaaaagaaaaaaaagaatagtaaacacaaatccctatatcacagctgctgagagatattatatagaactttgatatcattcttttctagtttcaccttgagcattgaagaaatattgttctggtcatttcttagaaaaaataataaggctattcaattctgtggttattattctacatatgttgcaatgtctttattaatagttagcttgatgtggtcagatatgaggttaggtagctgccaccttatttctgccaatacagaaagaggcaacactttttttccaattatatacattcctaagcattcagacatagtgataaagaaagtaggggctagggaggcaatatgtttgacgtttgagtaaagactgttggcaggaaaagagagggtaaaaagaaagggagaagagtatgacacttttcaatcttttgctcagatacaatgtttgttttagcaaatagtgtgcttctgtctaggttttggcttgcagattgacttagcagtatacaaataggtaccttttaaggaacataccagttatacataatcaggaactttaacctctttctctaataaaaatgaggaagatgatcttgatgattagctacatttcacaataataattccataataaaagtattatatgtctgagaaaaaggagaaggataattatggctgggatagtgacctttcttgcaagaacataggaaattatatattttaacttgttcatttttattgtattattattttttgagacaagatctcacactgttacccatgctagaatgcagtggtgctgtcacagctcactacagcctcaacctcctgggctcaagcaatcctcctacctcagcttcttaagtagttgggactacaggtgtgtgccaccacactcagctaattaattttttttttttaagagacagggtcttgctatgttgccttggctggcacttttttttttcttaatttttaaattttgttattttttttttagagatagggatctcactatgttgcccaggctgaactcgaactcctgggctcaagcagtcctcccaccttgacctcccaaagtgctgggattataggcataagccattgcacccggtgggcatttttcttttaaatagcagttatcttattaaatgtctaattaggtaacttctgcaactctataaccgagcccttttgaaaatggaaattttttttccccaacaaaatagacgtgaactgtgggtttttgttttgttttgtttttagtttttatttacttcagtgtgaatttttgttttgctgccaaaatcttaatgtgtttgatattgggatattgccataaaccctgctaagagtatatgtaacatagggtacatgcaagtattaccttttcaaaatcacacccattctgaatcctggaacacatctgacccccaagggttttgagtaagggattatggagctatatacattgtagaatcctacaaccccttcctcagaggttctgaattagggcccagaatctattgtcctaaccagtactgtaggtgatatttttagtgcagaaagttggaaatttgagtcttaactgaattcctcactgtttatcttctggttgacataattgtgtcttagaagctagttttcctacttctatcatgtcccactccacgtcttcaattcagccttcagaataagaagacccattttgtcttttaaaaagccaccatcttgaaaacatagaatttaggaggccagagttctaatagtgctactctgccagccagtagacaagcagccatgagcatgtcgcttagcttctctgtgcctcagtttccttacctgtaaatgtgagtgtcaaagtaggtttcagattatccatgtgctcacatcactctattactgaaagaacagcaaatatttctaattgtctcggcgaaaatgttcatatttccttttgtggaaattgattaattacattgattgagtacaccgtgcttcattggaatgctagaagaatagtgttctggccattagcgtggacttaaaaaaataaaccaaaacagtttagttttgaacaggtgatacttgcatatagtaaaaactgtaaaaacatgaagtatgtatatcagaaaatatttttcttccaccttgactcctggttccttttctccagtttcttgtctgtcttttcagagattaactgtgcatttataagaatatgaaacttgatcgcttctcggccttttggctaagatcaagtgtgaagaatatgaaacttgaaatgtttttaaaaagtatgcaggaaaaacaggttaattgtagggagaaaatagaaaatggtacaagagagctggattcctcatcacaattgtatttattttttgagacacagtcttgctctggcacctgggctagaatgcagtggggcaatcatagctcactgcagcctttacgtcctgggttcaagtgattctcctgcctcagcctccaaggagctgggactacaggcatgcaccaccacacccagctaatttttctttttttttttttgagacggagtttcgcccttgttgcccaggctggagtgcaatggtgcgatctcggcccactgcaacctccgcctcccaggttcaagcgattctcccacctcagcctcccgagtatctgagattacaggcatgtgccaccaagcccagctaattttgtatttttagtagacatgggggtttctccatgttgggcaggctagtctcgaactcccaacctcaggtgatctgctcgccttggcctcccaaagtgctgggattacatgcgtgagcaccgagcccagcctctggatatttttttttaatcatccgcatctctatttagtgtgctaaattttcctctaccttctttttttttttttttttttttttttttttagatggagtcttgctgtgtcgcccaggctggaatgcaatggtgcgatctcagctcactgcaacctctacctcccgggttcaagcaattctcctgcctcagcctcccgagtagctggaattacaggcacacgccactgcgcctggctaatttttgtatttttagtagagatggggtttcaccatgttggccaggctggtcttaaactcctgacctcgtgatccgcctgcctcggcctctcaaagtgctgggattacaggcgtgcacctgcactcggcctttttttgtatttttttttgtagagataaaggtcttgctttctggtctcgaactcctaggctcaagtgatcctcccacctcagcctcccaaagtgttgggattacaggcatgagtctctgtgcctagcccctcattgtacattatgaacatcatgcattaacaccctagtatgaaagtaaacaaacagtttttagagtggttggggtaaacaccagaatgaatagctagaagagatgaaaatggttgatgtaggtggcctgccatggctaggatattgcttttttttacatattcttgtatgtatgtgtgtatactgttttgattaaaaataacaattgatttaaaaagggaagtagaaaatgtagatgatcaaaatgaaataaataagaattgcctagtattacacccccaaatataacaactaacatttattttattttcttcctttttttttttgagagagtcttgctcagttgcccaggctggagtgcagtggtgcgatctcagcttactgcaacccccgcctcctgggttcaagtgattcttgtgcttcagccttttgagtagctgggattacaggcatgtcccaccacacccagctaatttttgtgtttttagtagagatggggtttcgccatgttggccaggctggtctcctacttctggcctcaagtgatccacccacctcagcctcccaaattgctgggattacagatgtgagccactgcacctggcttcttccatattttctatgcattttttggaatttttcagaaaaaattgaaaaaacagtacagggaacacctgtaatctgtcacacagatccaacaattattagcattttggccatatttgttctatgtatacttatgtgtgtgtgcatatatagaattttcttttgctgaatcacttgaaaatgagttgcagatatgagaattcacccctaactacaactactagctaactactactaatatgcatctcctgtgataaggatagtattccacataaccacaacaccattatcacataatttaagaaaattagaggccgggtacagtggctcacatctgtcatcccagcactttgggacgtcaaggcgggtggattgcttgaggccaggagtttgagaccagtctggccagcatggtgaaaccccgtctctactaaaaatacaaaaattggccgggcgtgatgatgcatgcccattgtaatcccagctacttgggaggctatggcacgagaatcacttgaacttgggaggtagaggttgcagtgagctgagatcatgtcactgcactccagcctgtgtgatagagcaagaccctgtctcaaaaaaaaaaaaagaagagaaaaaaagaaaacatgaatttcctaatgtcatttaatattcaaatcatattttgagtttccccagttcaccccaaaatattcagattttttcttatgcttttttttttttgaaccaagatccagccaaagtttgtgcattattagaactgaatgagaagaaaaaaacaacaaagaaaccaaagtttgtgcgttacatttggttgttatatctctttagtactttttaatctagaacagtcttccacctttttttccatgacattgaatgacattggatttttgaagagactaggacagttgtgtagaatgtccacaagcaaatattaacaaaagtgaccaggcatggtggctcatacctgtaatcccagccctttgggaggctgaagtaggcggattgcttgagcccaggagttcaagatcagcctgggcaatatggcgaaacctcatccctacaaaacatacaaaaattaccacgtctggctactcgggaggctgaagtgggaggattgcttgagcccaggagttggaggctgcagtgagctgtgattgtgccactgcactccagcctgggcaacagagtaagaccttttgaaacttctgttttttcactttatattactaatattttgttagatccacagtttcagtcctgtgtttaagtttcttcatagttggaccttaatatatgctttttcagatttctcccagtactttccagtaccagctttttccttgaactatttgccatggtgtctagtcatcctctctatactttttccagccttggcccaaaacagttagctcacattatttatcttatctgattttgtaatattttttgcctttttccacgtgttctgaattttctttatttgaaattgaaatgccgtctggtgttttatctgtttattcaagtcacagaattttagagtttgttggagtactggaaatttagtaagaaggctgaccttcaagtcttgactatgtgactgataagcttaggacttggtgaagtctcctcttttcgagacagtttccttaactgtaaaatgagaaggtagagttaaatgtcattaactattcccatgattatcaagggataagtatagtagaaaagtaatagagggccgggtgtggtgactcacgcctgtaatcccagccctttaggaggtggaggtgggcagatcatttgaggtcaagagttcgagaccagcctgatcaacatggtgaaacccagtttctactaaaaattcaaaaaaattagctgggcgtgatgacgcatgcctgtagtcccagcgactcgggaggctgaggcaggagaatttcttgaacccaggagacagaggttgcagtgagctgagatggcaccactgtactccagcctgggtgactgagcaagagcgaggctccatctcaaaaaaaaaaaaaaaaagaaaaagaaaaagtaatagaggagttcagaagcagagacagattactcttggctggtaagtagcatgagtgataaatttaagctgaatgattatggagcccaaatgaaataacttgtgtgaaatgttcttaaaataatatggtgttatataaatgtaactgatgttttaccaaacaaaatggagcagggtgctttgggtgaaagaaggggggcctgttttgatctgctgatggcataattattataatgtattaaagaatgtctcagaactgtagttgtcctaatagtactgcttgaaactttcaaattgttactgctttcagttgctttccgaagtggggataatggtggatctgatctcttctgttttgttcttgcagctctattatcaagtcctaaattttggaatgattgtctcatcggcactaatgatctggaaggggttaatggtaataactggaagtgaaagtccgattgtagtggtgctcaggtaacagtttttcctttcaaggcatggaattgcatggcattacttgggagaaaaattgagatatgaaataactggcatatcattctcttagaaactactcttttccagaaaagggcctggaagaaaattagtcactacttatcagttgtaagaaattctcaggctgggcacggtggcttatgcctgtaatcccaccaatttgggatgctgaggccggtggattacttgagctatggaatttgagactagcttgggcaacgtggtgaaaccctgtctccacaaaaaatacaaaaattagcgggtgtggtggcatggacctgtagtctcagctactcgggaggctgaggtgggaggatcacctaagccctagaggttgaggcctgcagtgagttgtgattgcaccactgcacttcagcctgggtgacagagcgagaccctgtctccaaaaaaaaaaaaaaaaagagagaaaagaaat

SEQ ID NO: 13351 - DNA, 894 bp, Homo sapiens
tttattgatttttctcattataggtcatattttcttgcctctttgcatgtctggtagttttttattggttgccagactttgtgaattttacctttttgggtgctggatatgtttggatttgcataaatattcttgagctttattctgggttacaggcaagttagttggaaacagtttggtcttctcaagctcttgtgaagctttgttagatggatccagagcggcctttagtctgtggctaattttgcactacaagtgagtaatacctttctgagtactctaatccaaagccccgtgaagatttccactctgtctggtggaaacaaactattcttacgccataagagctgtgagaattgttccatccgctgcttttagatggttgtttttccatcctcaggagtcccctcacatgcatgcactgatcattgcttttgcctccctgaactcccagttcttttttttgtgtgtgtgtgtctttgtttttttctttttccgtggagaacggggatcttgctgtattgcccaggcaggtcttgaactcctgggctcaagctatcctcctgcctctgcctccctaagagctgggattacaggcatgagccaccgtgcctggctgaactccccagttctttatcctcaagtcagggagactgctaggctctgtctgcatttctcctttgccctgtggtctggaaattctccgatctataagttgaggcagttgtaggtctcaccttctttgtttcccctttctaagtaatcacagtccttactacctgaacacagtcatatagccaatgtccgaaaacccttgtttcatatattttgtccagtgttttagttatttcaggcaggaaggtaaatttggtctctttaactcattttggctag

SEQ ID NO: 13352 - DNA, 894 bp, Homo sapiens; identical to SEQ ID NO: 13351

SEQ ID NO: 13353 - DNA, 519 bp, Homo sapiens
cacttctaaactagactccaggaattttgaaggcattaataccatctcttatggtgacaaatagtactgaattttttttctccactctgcttccttccctatctttgcactcatactcttagtgaatattttttttaaagatggggtctcgctctgttacccaggatagagtgcagtggcgccgtcataactcactgcagactccacctaccggtctcaagggatccttccattttagcctcctgagcaggtgggactgcaggcctgccccaccatgcctggttaattttttaatttttttgtagagacggtgtattagtccattttcatgctgctgataaagacgtacccaagactgggcaatttacgaaagaaagaggtttactggacttacagttccacgtgactggggaggccccacaatcatggcagaaggtgaaaggcaggtctcacatggcggcagacaagagaagagagcttttgcaggggaactcccctttttaaaaccatcagatctcg

SEQ ID NO: 13354 - DNA, 2010 bp, Homo sapiens; identical to SEQ ID NO: 11727

SEQ ID NO: 13355 - DNA, 2007 bp, Homo sapiens; identical to SEQ ID NO: 11728

SEQ ID NO: 13356 - DNA, 2005 bp, Homo sapiens; identical to SEQ ID NO: 11729

SEQ ID NO: 13357 - DNA, 2005 bp, Homo sapiens; identical to SEQ ID NO: 11730

SEQ ID NO: 13358 - DNA, 323 bp, Homo sapiens; identical to SEQ ID NO: 11731

SEQ ID NO: 13359 - DNA, 2654 bp, Homo sapiens; identical to SEQ ID NO: 11732

SEQ ID NO: 13360 - DNA, 2772 bp, Homo sapiens; identical to SEQ ID NO: 11733
  misc_feature (775)..(777): n equals a,t,g, or c
  misc_feature (885)..(885): n equals a,t,g, or c
  misc_feature (893)..(893): n equals a,t,g, or c
  misc_feature (1126)..(1127): n equals a,t,g, or c

SEQ ID NO: 13361 - DNA, 323 bp, Homo sapiens; identical to SEQ ID NO: 11734

SEQ ID NO: 13362 - DNA, 3136 bp, Homo sapiens; identical to SEQ ID NO: 11735

SEQ ID NO: 13363 - DNA, 14717 bp, Homo sapiens
cgtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgaggtgagagtccccctgccgagccgcgggatccagggcctgctgtgctgggcgcagccggccgggggctgcgggccccgagcccctttcgaccctggggccgcgtctctggagcgaagtttctctctgcagcttcttcgggggcccgctctgagctcagggcctggcactggctccaaggtacctagagtcatacaggcagagagttggccagaagttagttatatttggatttctcatcctgcattttctcaacccctcactcccatccaagctgggagagaaatgacgaaggcggccttttgctacctccaggcctcgcgggttgtaggtcatgggtgcccctgcttctcctgtcgagacagttcttgggagattctcgtcgacccaggaatcggccgctttccttgccccttctgcaggagcggggcttgattcttagccagaataggaaggaatcttcgaagagaatgggccaggaaagtttgattgtagcctcctcccccgccctcttttcgagcgaagaatatgtgtgcttaaaagtagaatcggcaggccgcccccagagggtggttctatcgaagccatcctgcacgtgaggctggtggctgtgtgtgaactgggtcaaccagtgtaagaatccgaatggtctatcagagaatgcttacaacctcccctaggtgatcctgagagttctaattccagcttagggggaaaatgattgtgacttaacttgctgggcaacagtggtttttaacggagctgctcccttcccaaagttagtgtgtgtcagaattgccagggcagctggttaaaaatgcagattcctagtccccactcgaaattgattatagtagattgagcttttttgctgggatccaggtttctgcaccaggggcttgtgatgtaggttgccccgagaccaccgttttggaagatcagctttataatctttgtttcttctgttggagggattggaaaacaggtttcagaaggaagttctttgctaggagattgatactgtatgctgggttcagaggctaccaaattggcagtatgccacctccagacaaccaggagacagactcactcttcactttctctcattctttttctgcgatgcccagatttggctcttgcttttactaaaatagttagttcttcccaagtcgattgcagtgtcctggagtttgttatattaaggagtttattgcctttcacacatgtgagggtcttgggacacagggctgttttgtgaagttctatgtttgtcttggagtttgttgagccctggcatgtagatcacagtagcctgggttcagctgactcagggctccagtctttagcagcggtaacagcagccaaagccagactttatagcaggaggtcattactatctctatcctggacccttcctctttcttcacgagtgtgggcagggaggaaagagcccttgaggaaactagacagtttgtggactttgcctcttgagatagcggtggtgagggtgctgagcggatggtttctttcacttagcagataccaggccttacattggttacatcgtcctattcagtctgttgtgcagagaataaagccgagtaagaccacacaggtttagttcccagatactgcccttattcagaaattctggttttaatttgctgatgcaggtggtgtgtgtgtgtgtgtgtgtgtgtgtgtgtttctttggcttggtcagcagtcagccaagatctgtgtccttgggttattggctcatggttgcagttccttggaaggagtttattgtagcaggtaaaattacatgagacctaccaaagcttgtgtgtactggagtcctatttcggacactggcccttggggcattgtataaatgaaggttccctgctaaggttcccctctccattctaccaatctgggtaagaattggagcagtattaaggcatggatggggagtgggaggtggcgcttgtcagctgcagtttggaccagcttgttgcaacattgcgcttaccaggttcctgagaaaggcattttgctggctttaggtcgggctgagatgcgcataagcttgcactctcaggaggcagctctctactaaggagtcagtcctaccaagggaagtccagctgttcacactgcctttcttctgggcctgtttggataagggtgtgccaggtatttgaagacccttgcctcgtgcagctatttacactgattgcagtaggaactgtatgccttatttcttttcccgcctgcctgtgatattgtttccagcatgctgagaaaagttgattttatgttgaatgaattcaggtatttgttaccaagttagtccagataagggtttggccttcttttgaacttgctgtttctgtgtagtttctttgtagttcaacattcttgtaattgtgagtggcccagggcacctagtggtttatgctttcaaaagcagttcagaatatttattgaatttcatttctgccttgaggatagctagtgcttacagcctgggaaaggctttttcagcctgtgtgcttccacagatgggagcaccactacagaaagtggtttagaagcgttcaccttggggttttggtatgaggcacattccagggtttttatttatttattgaaaatttttaattttttttttattgtagacacaggggtctcactatgttgcccaggctggtcttgaacttctgtcctcaagtgatcttcccaccttggcctcccaaactgctgggattacaggcatgaaccatcacgcctgaccatgttccagatttgtaacttggtcattttgagttcctcttcactctgactaggaaaagacctggttatttgacctgagggcacagaattttgcttgagtttagggaaggctatttcctcttcagagaaagatacctgctaaagtcgcaggtcctcgagaaacttgctttacgtctctgagccttgttttccttttcaaaaaatctctcatgctttagaaatttctgataagactgtaaactctcctgtccagagtagcttgaagtgtctctgtcactttttttttccttgatgaccttttacatggaattaaaaatagggcagaacatagctccagaggggaaaaaagttggttggggaccagagcctatcaggttgctaatgctgtaaccttaaggaataccctttcctgggctgccttcctttcacctggggaaggatttggctttggggaggtaagagcttgaaacatgggatgagagaggagtcactgctacctctgatttgctcaaagccatggcagttgtttagaattctctacctctactgtcacctaacaggcaggcttcatctgcaggccttccaaatagtggaagttcacaggtagaaaatttaggtccctgaatccgtgggttcgctgtctcagcccattcagaacaattctttaggtactggcctcactggagaaagaagtgatccagaagaacagtctagtgaccaggagatctgagggtagggtgggagtgacgctagagcaccaaggggggctttacagctgtgttctcatggaggacaggcttctgctcattctggctttcccactcttgtggttcccagttgcagttttccagttagttttattacttccttttcttttgatccattccctaaactgccttgagtggaggcatttgtttagtgcttatcgtgtgcatatccttgcctggctagcatacccatgtttctgtgtctctctccgtgtgaggcattgtattgagctatttatacagattgttttatccttaccacaatgctgtgggataggtggtgtccccattttataggtgagaaaacagacctagagaaaacaacttgttcagtgacacttcgtgtatgtcttttcctgaaccctgtgctgaattttccaaggagcctagttactacattgtctaaaactaagaaagagcagacataatgtaggcccttcggcccccttcctttttggttaactgagttatgccaatttcagcagtatgctgactgtacacttcattgtattttagagaaatctgtttcgctgtgaatgcataaaggctaaggagggaggaacaacccttgtttgctgctgcatctcttgggacttgggcaaattcaactttgcacgtggcagatctcttgggaaagccacttgggttttaaagggaaatattttaaaggtaattccaaggttgttaagtaatttttgttcacatggttgagttttcttcactgtgggactgagactgccgcagattacgttactgtcagttcctcactttttccacttggcaagaaaaaaaaaaagattcggcctggtgtggtggctcacgcctataatcctagcactttgggaggccgatgcgggcagatcacctgaggttggagttggagaccagcttggctaacatagtgaaagcccgtttctactaaaaatacaaaaaattagccgggcgtggtgatgcgtgcctgtaatcccagctacttgggaggctgaggcaggagaatcgcttgaccctgggaggtggaggttgcagtgagctgagattgcgccattgcactccagcttgggcaacaagagcgaaactccgtctccaaaaaacaaaaacaaaaacaaaaaaacaattccccacccatgcacaaaattttctgtgtatccgtaaatcaaatgtagtcgatgttccagatttgtaatgatcacagtcctcatggaagaaggaaattcttagagctcagttggaagagaaacagcagtctttcagtcttcataggtttgtatcccggggcaatggttttttgaggctggaaaggagggggagcatgttagcagtacatcctttgtatgcattgctcagctactctttgatttcttgaggagaaatagaaagaaaaaagtctgaagacaaaagtgcaatgagtttcctcttccattgtctcatcagtccctctgatctcgtggctaatgtcacttacaggaactgttaacagttatgtttatttttttgaggtcttgacctcaaccactgggtctttttgttaatcttttaccttttgccatgtcttctcccttgttgatgattcagaagataaagctctggggatgacagcccctggccttctcccaaaggatctagttgccagatgtcttcagggtcaccacgtgagattggaaggcagtcttgaaatcttaatttcatgcgggaggagagactacatgacggctacatctgtagttggaacagtatatttatggagcactggaaagccttactgtgtttataggataaaggagtcaggctactctctggaggaagcagaactatttacctctgagactgaaatgtgatatcttatatttgcacaaaaaagattcggcctggcgcggtggctcacgcctgtaatcctagcactttgggaggccgatgcgggtggatcacctgcggtcaggagtttagtgtgttgtgcgagaggaagaaaaaaacatatatacaactgtcttacaccaaggttgggagagggccagggccaagagaggttttctgctcttctgatactgacccgaggtaagtaactttttacttttatcctctctcattccttgtcagtttgtgaaatgtgaaaggtgattcccctaggacttggacatcttaggcagattgccttgccctgcaggatgctccagccttgtggacagagtggcatggcttcactgctttgcaggcacctccttcattgtcatttattcattcagcaaactgtatgagtggcgactatgtgccaggtcccgtgctaggcactggaggtgcagtggtgactttttttttctgctgttggtttatctgagtgaatgttcaagtaagtaggtgaggtggagttttgtgagtctgtgggaaggaaggaaattagcatcacacctttcttttatgagcctgtttttgtttacagctttggaactttttgaatgaaaattataaaaaaaacacacaacaactaaagctggaattttattcgtaaggacaatgaagaatgactttccaaagcagatatcctgtttgttttagactctgggcttttctgaatgagagaaaacattctttgaacttcatcttgtatggagttcctggccatcccccttgttttaggaggtttctctgaagccctccctcttggggaaccaggcagctgcaacacagcactttcttctggtaatgagttagacttgttctccgtacagtcagggggaaaaagtcattttaatgtgcttttagaaagttccgctctgaggtttacaggggctgttggcctgattagtgtttagtttctttcattttactcttccatagtaatggctgtatgattcctgcctttgttggagctctgtttggagccaggtgcagagtgggtggccccttttatggagagggttattagcattgccctggaaatgcctctggctgttctggggtctttgcttttcttttgtgtcttgcctctgatgtgctttctctttgtcttttgtcctcagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtgaggcctagtcaggctgctgcttgaccagtaggacattgctgctcttggacaatccacgattatggggctagagagtgtgagagtctctccagaaaggcagaacagatgagctctagagaagcatgttccatagtgcacaaggctgcacttgccttgggggtgagtgacagaaagcaatgccagaatccttgttttgccaactaactgatcctgttaaggccctcctggctacttccctccatggtttgccgcaccttcttgtttttagccttatttttcctctgtcccttcctgtgaatttccttcttcctatgctaagctttttgtttgtattctttgttccttaaagccaatataagaactcctgggcagtgaaggaacacggctttgatttgacccgggttaaggatgctaaccaccctggatatccagacccatcatttcttaaattatttttgaacttcaagcccaaacacgtgcatgatgtccaactgcttgaaaggatgtaaagctgatggttttgacattgttttcttttcttatcctggaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggtaattcccctattctgcccattgctgaagagagtgggtacaggggaagttgtttgctgctgtgtggggttgaccactgtttcccttttcctaggggtactatgacaatcccaaggtctgtgcactctacatcatggctgggacagtggatggtaggttgtgttctgacctgcttttttgacttgagtggagggatatggttgaggaagcccttgggaggtaattgagctgatcactattttggaaacacttaaagctaaattgtaggggattcagaatcagttggataaggatgaagcataacatggtactagccacaagctttggagtcaggtctatgtatatcttgttgctgccatttaatcagatgtttgtcttggatggatgcttttaatttccctataaattgggattaataatggtacctattggtgtaccctgacctttgtagtcatttgggatcacctaaaacttgtccttattctgtttgtttgacatctctttcctaggggaaaaaaaggtaaaaggaggagtcctgtaggcttttggtatgctctgaaagattccagcattgctggactgcactgggacaaaacttcacttatttatgtctccttatccttgggatcaagtcttagagtatatttctttctcagggtttagattctcctggctgccagcatctcaggctgatttttgcagagaaagctgcgtctttgtgacatttctcccccattccacctctgtacctttccccaactcaatcttgaatgcactgaggatttcatcctgttgtcttgatgtcccccaaatgctgatattatgacatctaggaggatgaatgtcttaccaccaaacagacctgtgttcaagtccctgaggaggaggcaggacagagggatagtgtgtgctgggaacccagaactctctgggtcaacgtttcttcagttgttgtgtgaatcaaaagggaatgtgggcttgtgggaggaggagggatttgaaaaggctaaagtttaggcattggatcattgtccctgtccagtctggttatcttggggctctgtaaaagtagaacaggaaggtaagatagtgaacctccctatgagcacggctttttctactttctagttaaatctaaagcttttgcagcactctgctgttctgtagaccagaggctatttctgctacttctggtcttttctctggacccgggttcaatcacagcaatctctttattgtggcttatttgctgcttttaagggtctctcttacttaaatgctgtgggtcttaacagtgttttcttccttgtgttagatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagatttgagccctactaagtgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctcctcctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgacactctg

SEQ ID NO: 13364 - DNA, 1134 bp, Homo sapiens
gtgacgctagagcaccaaggggggctttacagctgtgttctcatggaggacaggcttctgctcattctggctttcccactcttgtggttcccagttgcagttttccagttagttttattacttccttttcttttgatccattccctaaactgccttgagtggaggcatttgtttagtgcttatcgtgtgcatatccttgcctggctagcatacccatgtttctgtgtctctctccgtgtgaggcattgtattgagctatttatacagattgttttatccttaccacaatgctgtgggataggtggtgtccccattttataggtgagaaaacagacctagagaaaacaacttgttcagtgacacttcgtgtatgtcttttcctgaaccctgtgctgaattttccaaggagcctagttactacattgtctaaaactaagaaagagcagacataatgtaggcccttcggcccccttcctttttggttaactgagttatgccaatttcagcagtatgctgactgtacacttcattgtattttagagaaatctgtttcgctgtgaatgcataaaggctaaggagggaggaacaacccttgtttgctgctgcatctcttgggacttgggcaaattcaactttgcacgtggcagatctcttgggaaagccacttgggttttaaagggaaatattttaaaggtaattccaaggttgttaagtaatttttgttcacatggttgagttttcttcactgtgggactgagactgccgcagattacgttactgtcagttcctcactttttccacttggcaagaaaaaaaaaaagattcggcctggtgtggtggctcacgcctataatcctagcactttgggaggccgatgcgggcagatcacctgaggttggagttggagaccagcttggctaacatagtgaaagcccgtttctactaaaaatacaaaaaattagccgggcgtggtgatgcgtgcctgtaatcccagctacttgggaggctgaggcaggagaatcgcttgaccctgggaggtggaggttgcagtgagctgagattgcgccattgcactccagcttgggcaacaagagcgaaactccgtctccaaaaaacaaaaacaaaaacaaaaaa

SEQ ID NO: 13365 - DNA, 1134 bp, Homo sapiens; identical to SEQ ID NO: 13364

SEQ ID NO: 13366 - DNA, 14719 bp, Homo sapiens
cgtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgaggtgagagtccccctgccgagccgcgggatccagggcctgctgtgctgggcgcagccggccgggggctgcgggccccgagcccctttcgaccctggggccgcgtctctggagcgaagtttctctctgcagcttcttcgggggcccgctctgagctcagggcctggcactggctccaaggtacctagagtcatacaggcagagagttggccagaagttagttatatttggatttctcatcctgcattttctcaacccctcactcccatccaagctgggagagaaatgacgaaggcggccttttgctacctccaggcctcgcgggttgtaggtcatgggtgcccctgcttctcctgtcgagacagttcttgggagattctcgtcgacccaggaatcggccgctttccttgccccttctgcaggagcggggcttgattcttagccagaataggaaggaatcttcgaagagaatgggccaggaaagtttgattgtagcctcctcccccgccctcttttcgagcgaagaatatgtgtgcttaaaagtagaatcggcaggccgcccccagagggtggttctatcgaagccatcctgcacgtgaggctggtggctgtgtgtgaactgggtcaaccagtgtaagaatccgaatggtctatcagagaatgcttacaacctcccctaggtgatcctgagagttctaattccagcttagggggaaaatgattgtgacttaacttgctgggcaacagtggtttttaacggagctgctcccttcccaaagttagtgtgtgtcagaattgccagggcagctggttaaaaatgcagattcctagtccccactcgaaattgattatagtagattgagcttttttgctgggatccaggtttctgcaccaggggcttgtgatgtaggttgccccgagaccaccgttttggaagatcagctttataatctttgtttcttctgttggagggattggaaaacaggtttcagaaggaagttctttgctaggagattgatactgtatgctgggttcagaggctaccaaattggcagtatgccacctccagacaaccaggagacagactcactcttcactttctctcattctttttctgcgatgcccagatttggctcttgcttttactaaaatagttagttcttcccaagtcgattgcagtgtcctggagtttgttatattaaggagtttattgcctttcacacatgtgagggtcttgggacacagggctgttttgtgaagttctatgtttgtcttggagtttgttgagccctggcatgtagatcacagtagcctgggttcagctgactcagggctccagtctttagcagcggtaacagcagccaaagccagactttatagcaggaggtcattactatctctatcctggacccttcctctttcttcacgagtgtgggcagggaggaaagagcccttgaggaaactagacagtttgtggactttgcctcttgagatagcggtggtgagggtgctgagcggatggtttctttcacttagcagataccaggccttacattggttacatcgtcctattcagtctgttgtgcagagaataaagccgagtaagaccacacaggtttagttcccagatactgcccttattcagaaattctggttttaatttgctgatgcaggtggtgtgtgtgtgtgtgtgtgtgtgtgtgtgtgtttctttggcttggtcagcagtcagccaagatctgtgtccttgggttattggctcatggttgcagttccttggaaggagtttattgtagcaggtaaaattacatgagacctaccaaagcttgtgtgtactggagtcctatttcggacactggcccttggggcattgtataaatgaaggttccctgctaaggttcccctctccattctaccaatctgggtaagaattggagcagtattaaggcatggatggggagtgggaggtggcgcttgtcagctgcagtttggaccagcttgttgcaacattgcgcttaccaggttcctgagaaaggcattttgctggctttaggtcgggctgagatgcgcataagcttgcactctcaggaggcagctctctactaaggagtcagtcctaccaagggaagtccagctgttcacactgcctttcttctgggcctgtttggataagggtgtgccaggtatttgaagacccttgcctcgtgcagctatttacactgattgcagtaggaactgtatgccttatttcttttcccgcctgcctgtgatattgtttccagcatgctgagaaaagttgattttatgttgaatgaattcaggtatttgttaccaagttagtccagataagggtttggccttcttttgaacttgctgtttctgtgtagtttctttgtagttcaacattcttgtaattgtgagtggcccagggcacctagtggtttatgctttcaaaagcagttcagaatatttattgaatttcatttctgccttgaggatagctagtgcttacagcctgggaaaggctttttcagcctgtgtgcttccacagatgggagcaccactacagaaagtggtttagaagcgttcaccttggggttttggtatgaggcacattccagggtttttatttatttattgaaaatttttaattttttttttattgtagacacaggggtctcactatgttgcccaggctggtcttgaacttctgtcctcaagtgatcttcccaccttggcctcccaaactgctgggattacaggcatgaaccatcacgcctgaccatgttccagatttgtaacttggtcattttgagttcctcttcactctgactaggaaaagacctggttatttgacctgagggcacagaattttgcttgagtttagggaaggctatttcctcttcagagaaagatacctgctaaagtcgcaggtcctcgagaaacttgctttacgtctctgagccttgttttccttttcaaaaaatctctcatgctttagaaatttctgataagactgtaaactctcctgtccagagtagcttgaagtgtctctgtcactttttttttccttgatgaccttttacatggaattaaaaatagggcagaacatagctccagaggggaaaaaagttggttggggaccagagcctatcaggttgctaatgctgtaaccttaaggaataccctttcctgggctgccttcctttcacctggggaaggatttggctttggggaggtaagagcttgaaacatgggatgagagaggagtcactgctacctctgatttgctcaaagccatggcagttgtttagaattctctacctctactgtcacctaacaggcaggcttcatctgcaggccttccaaatagtggaagttcacaggtagaaaatttaggtccctgaatccgtgggttcgctgtctcagcccattcagaacaattctttaggtactggcctcactggagaaagaagtgatccagaagaacagtctagtgaccaggagatctgagggtagggtgggagtgacgctagagcaccaaggggggctttacagctgtgttctcatggaggacaggcttctgctcattctggctttcccactcttgtggttcccagttgcagttttccagttagttttattacttccttttcttttgatccattccctaaactgccttgagtggaggcatttgtttagtgcttatcgtgtgcatatccttgcctggctagcatacccatgtttctgtgtctctctccgtgtgaggcattgtattgagctatttatacagattgttttatccttaccacaatgctgtgggataggtggtgtccccattttataggtgagaaaacagacctagagaaaacaacttgttcagtgacacttcgtgtatgtcttttcctgaaccctgtgctgaattttccaaggagcctagttactacattgtctaaaactaagaaagagcagacataatgtaggcccttcggcccccttcctttttggttaactgagttatgccaatttcagcagtatgctgactgtacacttcattgtattttagagaaatctgtttcgctgtgaatgcataaaggctaaggagggaggaacaacccttgtttgctgctgcatctcttgggacttgggcaaattcaactttgcacgtggcagatctcttgggaaagccacttgggttttaaagggaaatattttaaaggtaattccaaggttgttaagtaatttttgttcacatggttgagttttcttcactgtgggactgagactgccgcagattacgttactgtcagttcctcactttttccacttggcaagaaaaaaaaaaagattcggcctggtgtggtggctcacgcctataatcctagcactttgggaggccgatgcgggcagatcacctgaggttggagttggagaccagcttggctaacatagtgaaagcccgtttctactaaaaatacaaaaaattagccgggcgtggtgatgcgtgcctgtaatcccagctacttgggaggctgaggcaggagaatcgcttgaccctgggaggtggaggttgcagtgagctgagattgcgccattgcactccagcttgggcaacaagagcgaaactccgtctccaaaaaacaaaaacaaaaacaaaaaaacaattccccacccatgcacaaaattttctgtgtatccgtaaatcaaatgtagtcgatgttccagatttgtaatgatcacagtcctcatggaagaaggaaattcttagagctcagttggaagagaaacagcagtctttcagtcttcataggtttgtatcccggggcaatggttttttgaggctggaaaggagggggagcatgttagcagtacatcctttgtatgcattgctcagctactctttgatttcttgaggagaaatagaaagaaaaaagtctgaagacaaaagtgcaatgagtttcctcttccattgtctcatcagtccctctgatctcgtggctaatgtcacttacaggaactgttaacagttatgtttatttttttgaggtcttgacctcaaccactgggtctttttgttaatcttttaccttttgccatgtcttctcccttgttgatgattcagaagataaagctctggggatgacagcccctggccttctcccaaaggatctagttgccagatgtcttcagggtcaccacgtgagattggaaggcagtcttgaaatcttaatttcatgcgggaggagagactacatgacggctacatctgtagttggaacagtatatttatggagcactggaaagccttactgtgtttataggataaaggagtcaggctactctctggaggaagcagaactatttacctctgagactgaaatgtgatatcttatatttgcacaaaaaagattcggcctggcgcggtggctcacgcctgtaatcctagcactttgggaggccgatgcgggtggatcacctgcggtcaggagtttagtgtgttgtgcgagaggaagaaaaaaacatatatacaactgtcttacaccaaggttgggagagggccagggccaagagaggttttctgctcttctgatactgacccgaggtaagtaactttttacttttatcctctctcattccttgtcagtttgtgaaatgtgaaaggtgattcccctaggacttggacatcttaggcagattgccttgccctgcaggatgctccagccttgtggacagagtggcatggcttcactgctttgcaggcacctccttcattgtcatttattcattcagcaaactgtatgagtggcgactatgtgccaggtcccgtgctaggcactggaggtgcagtggtgactttttttttctgctgttggtttatctgagtgaatgttcaagtaagtaggtgaggtggagttttgtgagtctgtgggaaggaaggaaattagcatcacacctttcttttatgagcctgtttttgtttacagctttggaactttttgaatgaaaattataaaaaaaacacacaacaactaaagctggaattttattcgtaaggacaatgaagaatgactttccaaagcagatatcctgtttgttttagactctgggcttttctgaatgagagaaaacattctttgaacttcatcttgtatggagttcctggccatcccccttgttttaggaggtttctctgaagccctccctcttggggaaccaggcagctgcaacacagcactttcttctggtaatgagttagacttgttctccgtacagtcagggggaaaaagtcattttaatgtgcttttagaaagttccgctctgaggtttacaggggctgttggcctgattagtgtttagtttctttcattttactcttccatagtaatggctgtatgattcctgcctttgttggagctctgtttggagccaggtgcagagtgggtggccccttttatggagagggttattagcattgccctggaaatgcctctggctgttctggggtctttgcttttcttttgtgtcttgcctctgatgtgctttctctttgtcttttgtcctcagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtgaggcctagtcaggctgctgcttgaccagtaggacattgctgctcttggacaatccacgattatggggctagagagtgtgagagtctctccagaaaggcagaacagatgagctctagagaagcatgttccatagtgcacaaggctgcacttgccttgggggtgagtgacagaaagcaatgccagaatccttggtttgccaactaactgatcctgttaaggccctcctggctacttccctccatggtttgccgcaccttcttgtttttagccttatttttcctctgtcccttcctgtgaatttccttcttcctatgctaagctttttgtttgtattctttgttccttaaagccaatataagaactcctgggcagtgaaggaacacggctttgatttgacccgggttaaggatgctaaccaccctggatatccagacccatcatttcttaaattatttttgaacttcaagcccaaacacgtgcatgatgtccaactgcttgaaaggatgtaaagctgatggttttgacattgttttcttttcttatcctggaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggtaattcccctattctgcccattgctgaagagagtgggtacaggggaagttgtttgctgctgtgtggggttgaccactgtttcccttttcctaggggtactatgacaatcccaaggtctgtgcactctacatcatggctgggacagtggatggtaggttgtgttctgacctgcttttttgacttgagtggagggatatggttgaggaagcccttgggaggtaattgagctgatcactattttggaaacacttaaagctaaattgtaggggattcagaatcagttggataaggatgaagcataacatggtactagccacaagctttggagtcaggtctatgtatatcttgttgctgccatttaatcagatgtttgtcttggatggatgcttttaatttccctataaattgggattaataatggtacctattggtgtaccctgacctttgtagtcatttgggatcacctaaaacttgtccttattctgtttgtttgacatctctttcctaggggaaaaaaaggtaaaaggaggagtcctgtaggcttttggtatgctctgaaagattccagcattgctggactgcactgggacaaaacttcacttatttatgtctccttatccttgggatcaagtcttagagtatatttctttctcagggtttagattctcctggctgccagcatctcaggctgatttttgcagagaaagctgcgtctttgtgacatttctcccccattccacctctgtacctttccccaactcaatcttgaatgcactgaggatttcatcctgttgtcttgatgtcccccaaatgctgatattatgacatctaggaggatgaatgtcttaccaccaaacagacctgtgttcaagtccctgaggaggaggcaggacagagggatagtgtgtgctgggaacccagaactctctgggtcaacgtttcttcagttgttgtgtgaatcaaaagggaatgtgggcttgtgggaggaggagggatttgaaaaggctaaagtttaggcattggatcattgtccctgtccagtctggttatcttggggctctgtaaaagtagaacaggaaggtaagatagtgaacctccctatgagcacggctttttctactttctagttaaatctaaagcttttgcagcactctgctgttctgtagaccagaggctatttctgctacttctggtcttttctctggacccgggttcaatcacagcaatctctttattgtggcttatttgctgcttttaagggtctctcttacttaaatgctgtgggtcttaacagtgttttcttccttgtgttagatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagatttgagccctactaagtgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgacactctg

SEQ ID NO: 13367 - DNA, 477 bp, Homo sapiens
tacaccaaggttgggagagggccagggccaagagaggttttctgctcttctgatactgacccgaggtaagtaactttttacttttatcctctctcattccttgtcagtttgtgaaatgtgaaaggtgattcccctaggacttggacatcttaggcagattgccttgccctgcaggatgctccagccttgtggacagagtggcatggcttcactgctttgcaggcacctccttcattgtcatttattcattcagcaaactgtatgagtggcgactatgtgccaggtcccgtgctaggcactggaggtgcagtggtgactttttttttctgctgttggtttatctgagtgaatgttcaagtaagtaggtgaggtggagttttgtgagtctgtgggaaggaaggaaattagcatcacacctttcttttatgagcctgtttttgtttacagctttggaactttttgaatgaaaattataaa

SEQ ID NO: 13368 - DNA, 399 bp, Homo sapiens
cagggtttttatttatttattgaaaatttttaattttttttttattgtagacacaggggtctcactatgttgcccaggctggtcttgaacttctgtcctcaagtgatcttcccaccttggcctcccaaactgctgggattacaggcatgaaccatcacgcctgaccatgttccagatttgtaacttggtcattttgagttcctcttcactctgactaggaaaagacctggttatttgacctgagggcacagaattttgcttgagtttagggaaggctatttcctcttcagagaaagatacctgctaaagtcgcaggtcctcgagaaacttgctttacgtctctgagccttgttttccttttcaaaaaatctctcatgctttagaaatttctgataagac

SEQ ID NO: 13369 - DNA, 477 bp, Homo sapiens; identical to SEQ ID NO: 13367

SEQ ID NO: 13370 - DNA, 3333 bp, Homo sapiens
tggagttcaaagccatgctgatcgctgtgggcatccacctgctgctgctcatgttcgaagtcctggtctgcgacagggtggagaggggcacccacttctggctgctggtcttcatgcctctcttcttcgtgtcccccgtgtccgtggctgcctgcgtctggggctttcgacacgataggtcgctggagctggagatcctgtgctcggtcaacatcctgcagttcatcttcatcgccctaaagctggacaggattattcactggccgtggctggtggtgtttgtgcccctgtggatcctcatgtcgttcctttgcctggtcgtcctctattacatcgtctggtccctcctgttcctgcggtccctggatgtggttgccgagcagcggagaacacacgtgaccatggctatcagttggataacgattgtcgtgcctctgctcacttttgaggtcctgctggttcacagattggatggccacaatacattctcctacgtctccatatttgtccccctttggctttccttactaactttaatggccacaacatttaggcgaaaggggggcaatcattggtggtttgcattcgcagagacttctgtcagtttctgcttgaaattttcccatttttaagagaatatgggaacatttcatatgatctccatcacgaagatagtgaagatgctgaagaaacatcagttccagaagctccgaaaattgctccaatatttggaaagaaggccagagtagttataacccagagccctgggaaatacgttcccccccctcccaagttaaatattgatatgccagattaaactcctagagaggacccaggcacacacagactccacttggccttcgcctcttgttcattcatcccaaacctggaaatggaaacaggcttcaaacactcgtctcacgccgtgtttgagatcaccgcctcatcagtatgcatcatagatggaggtggtttcagtatgtgggtgtgtgtgatgtgtacctgggtaagagacttgctttccaggttcgcactttcaggtgtagctgggggcagtaagtcgaattgttttagtaggtcctcaaaaggaataaccacacagctgtttgtttaaatgctactgtacctatcaaaactattgtttaaaaagtatttttatacactgctaatctaaaattgtatttcagattgtgcctgtcataacaatagcaaatgtaaaaagttctctttcccaccacttgtttataaacctcatagttgatatttttagtgttcctactgttaaaatactctctccttgggctttgctgatactggtctttaatattctgataggtgaatttttctaatggaatgaacccatgcatatatagtatttatatgaatattttagcagtgtaatatgttgaattctagttctctgcattaccattattacgttaaagtattttttaaagcttaggtgtgaagatatgtgtctattgcagatgtccttgaaaactgcataaaacagtatgtgcctggtgtggatcttaccaaagtactaggcatgaatgtagggactgcaaatcccatgggtcttaatatttaggtgttagtaaccaaggtctctggtagtacccgttagtagaggaagaggccactgcccttgggaacttgtgacaggctctagtgtggtaccaggccataaagtgacactgttatttagcaacttgaatttttccacacaggtagtaactgtgtggaaataagcaacaagtggtttgtccatttctaagaatcttaaactattagttggctgtagtgtgaagcattacttgtcattggaaagatggagagagtggccttaaccggaagtggtcagtagaagcaggtgtcattttaagggccaaactttaatctgtcagcaatagggaaacaactgttcaaattatctttgtagataagaacagtgtttcttttttcttttcttttgtttttttgtttgtttgttttgttttgttttgagacagagtttcactcttgttgcccaggctggagtgcaatggcacaatcttgatctcagctcgccgcagcctccgcctcccggttcaagcgattcttctgcctcagcctcgcgagtagctgggattacaggcatgcaccaccacgcctggctaatttcgtatttttaatagagacagggtttctccatgttggtcaggctggtctcaaactcctgacttgaggtgatctgcccgccttggcctcccaaagtgctgggattacaggcgggaaccactgcacccggcaggtacagtgtttctttaggtgctggtggtacaccagggaatcagggcagaagctggatcctgcaagagtaatgtttgagaacaaataaatactttcgaaaggaggtcgaaacaaaaaggagtgtaggtgttattactgcagagaagactgaatggagtccacttttcttattagtaacttactaaaaatgatctcaaatgggctccacacactttgccctggccatgaggcaaacttgttgggtttggagaaaaacacataaccctaaattcactatttttgccctatataaaacattaaaataacatgctctgtacacatgctgtcaacaaaagccagctctaggaacctgagtgccagaatgcctgagggagctacagctgggcttagttggctgggattgagctcgctgtctgagggagctcgctctgtctctctcacactggcagtttacaccagccggcagccctgagcagcagtgggtgtaactttttataaataaggattcattgattcattcatattctcaatatttcttgaagacctaccccgagccaagcatggtgccaggcagtggggatgcagtggagagcaaacagccctgcccatgcaaagtgtcctgtacggtgagaagtgtgagctgcacccacaaagggaaagagcccagtgcagcttttgcaaaatgcagggaaggatgctgctagcctcagggtgacctagaactttaagctcatctttgttttcaggagcccagtgcctcccctccacccctaaagaatatctcaaagacgtggattttcatttcagtaagatttaggggtgcatgggcaggcagtgctggaggaactgggaggcaggtttggaggctgcagtgggaccactggcccctcctggctacagtttcaggccaggagcttgttggcacctggtgcaaactcccaaacctgaggggtccccacaaccccccagcccatcttaacttcctcttcccccaagctatctggtgttggaaagccagcatctagtgtggaaacaagcttt

SEQ ID NO: 13371 - DNA, 181 bp, Homo sapiens
aaccccaggggcctgttccaggacttcaaccccagtaagtttctcatctacacctgcctgctgctcttctcggtgctgctgcccctccgcctggacggcatcatccaatggagctactgggccgtctttgcccccatatggctgtggaagcttctagtcgtcgcaggcgcctccgtgggcg

SEQ ID NO: 13372 - DNA, 1156 bp, Homo sapiens
gggaaacagggtcgaatcggggtcctggagtctggttcgagcagatatgtctctctttgtcttggacaggagtgaggagaatatggggagaggaacagttttttctttcacaatgttgggactcacaatatgtatctcccctgccaaatggctttttctttatttgtgctatttgtgatatggttgctcttgaaaatttttcaagctgggccacagctcatgagtttggctcatgggtcagctaccctagtgctagatgggatgaacatctttggccctagtggctatggtcaggagtgcagggtcgcatgcaactactttagaaaatgtagagttcccagctgggcgcgttgtctcatgcctgtaatcccagcactctgggaggctgaggcgggcagatcagctgaggttaggagtttgagaccagccttggccaacatggtgaaatcctatctctattaaaaataaaaaaattagctgggcatggtggcccatgcctgtagtctcagctacctgggaggctgaggtgggagtattttttaacccaggaggcggagattgtggtgagctgaggtcacgccattgaactccagcctgggagacacagtgagatcctgtctccaaaaaaaaaaaaaaataaaaataaaaaaaataaaaataaataaataaataaaaggatatttccccactgtgtctgccaatggttctcttccgaggaaacacactcctagcttcgtgctttggagccatttctcaggagaatctctctggagaatgatttcctccttgttattcatcacggtcctttcaaactgaattaaatcgtcctgcctttggatttttgtttgctcaaggaacttaattttactaaactattctctcgcatttatgggatacttttccctcaagagcaaaactggggcaacttcagagcacacatgtgataaaatacctctcctgggcactaccagtcagaagacaaagtaagtgacatgaatgtcaataatgaagttcctattctcattccctcacatacttgagtcttctagtcccctacaaagtctctccaaatatttctgactttaccaagagaaacctctcatgtggccacgaaccagcctgttgtatgtagtccccaggtggctcctgccatgtt

SEQ ID NO: 13373 - DNA, 1155 bp, Homo sapiens
gggaaacagggtcgaatcggggtcctggagtctggttcgagcagatatgtctctctttgtcttggacaggagtgaggagaatatggggagaggaacagttttttctttcacaatgttgggactcacaatatgtatctcccctgccaaatggcttgttctttatttgtgctatttgtgatatggttgctcttgaaaatttttcaagctgggccacagctcatgagtttggctcatgggtcagctaccctagtgctagatgggatgaacatctttggccctagtggctatggtcaggagtgcagggtcgcatgcaactactttagaaaatgtagagttcccagctgggcgcgttgtctcatgcctgtaatcccagcactctgggaggctgaggcgggcagatcagctgaggttaggagtttgagaccagcctggccaacatggtgaaatcctatctctattaaaaataaaaaaattagctgggcatggtggcccatgcctgtagtctcagctacctgggaggctgaggtgggagtattttttaacccaggaggcggagattgtggtgagctgaggtcacgccattgaactccagcctgggagacacagtgagatcctgtctccaaaaaaaaaaaaaaataaaaaaaaaaaaaataaaaataaataaataaataaaaggatatttccccactgtgtctgccaatggttctcttccgaggaaacacactcctagcttcgtgctttggagccatttctcaggagaatctctctggagaatgatttcctccttgttattcatcacggtcctttcaaactgaattaaatcgtcctgcctttggatttttgtttgctcaaggaacttaattttactaaactattctctcgcatttatgggatacttttccctcaagagcaaaactggggcaacttcagagcacacatgtgataaaatacctctcctgggcactaccagtcagaagacaaagtaagtgacatgaatgtcaataatgaagttcctattctcattccctcacatacttgagtcttctagtcccctacaaagtctctccaaatatttctgactttaccaagagaaacctctcatgtggccacgaaccagcctgttgtatgtagtccccaggtggctcctgccatgtt

SEQ ID NO: 13374 - DNA, 21329 bp, Homo sapiens
ttatttttagcaaagcttcttttgaaaatttgaatttggtcaaggactggatttgttgacataccctgagtagctatgaagaacagaatgtcctggtagccacaaggaactgtggtagctgctgtcccagcagcagcagaacgacactttgtgaggcttaggtgctggccagggaggtgaggataacaggagtatgacttctcaggcacaacttccccattggataactttagggtccgggtgcaaggaggaagggacctcaggtgcagactgccagtcttcccctctcccatttcaagctggatcaagctgggtgacagaattcaaccccactgtctctcctactgccctgggagaaaacttgtatctcccttgaagccaggcagaggttgtaggtagaatcatttttattggagcatgacctgtttggggcttataactctgcagcccctatgggtagctgggggtgggggaagatagtatcaaaaaacggtgaagagagctgatgaggctgtggggactggccggaagctgctggcagggtggagtgggctggggccccggcagattcagatcgaggtacagcagcgttaataatactcttggagcgttaatactctggggaggggcaggcacttggggggccctagggcatgaaggcacttggggttggggaggggacaggggatgtactgcgggactgggcggggccaggccctggggtttggcaggcactttggggagtgctggggttgggcaggttgggccccgacagcccagaaggctttggtagtggcacgcacagtctctgggccgggtctgcattaaatagaagaggcttctttagtgctcatctcgaagctctgaaggcagaaacttgtactgctgctgccggatctgggccagtttcttccgcgcctcttccagctctcgttccttccgaagcatttcttcctgtgctgcgatgatctgagggtggagatcggggacttagttcagtgaggatgcacagcaggggcatagggtagttgggaccagcgcaggcaacatgactgccctcctgacagcgtccctcagcatctggggtgaagctcacctgggcaatgccgccaaccatcttctctttcaccaccactgtctcattctcctgctcttcaaaggctgcagccttctgtgctgctttcaccagattatctgaggctcgcttcactgcgttgccagcagcctgggcagagagaaagtggcctaggttgagaactcaggtacggtcccagttgagacagtacctcaattctctcatagaaacatacatctcgggagtgacagtttgaagcagtatagcccaagggacaatgggatgggtcagggttctcacctgaagtcgtttcattgcctccgagtcctggtcagccttgaccttgcaggccacaaggagctgggctgtggaggcagctacctgcttggctgatgagatgagcttctcctggctggcatggccttgtacagctgcattggctgcctcacacagattgttggtggccgcagccaccatccgggcctaaagcagggagagtttgcttaaaaatatgccccttgccctggtccatccccactccagccttctcaagtctctcaaactgagagagacctagtggtattgcacacttacagcagaaatgaggccctgggaccactgcccatcgtccagtgcattggctggaatggcacccacctgtaggaaggagaagagcctacttagacctgcattttcctcacttcaaagactcgctggctatggatgtggatgtggacatcaaagtgccaacctgtccccattcttctgggtatttaagcactcaccttcccttgggccactagttctctctgggcagccgacgcagcctttaccagtgcactggtggctgctgcaatggacttggcagcttctagtatctgctcctcaaagttcaaggactcatctgcctcctgcaataagcgaaggttgcagaaagagatgtaaagtcagagatgaaggtggggacactgccatggtgagggtggaagaggaagggagcaggactgaccttgggtttggcccggggcttcagctgctctagctttttggctgcagcctcaatggcggctgcagctcccaggagctcattctcagcaatgactgtggggtcctctgggtctacccattctgttcctggtgggatgaaggaagaggaaagaggctaaggcagagtggggaggtcaaaagcaccagggagcatggttagtatcatcaggccctggcatctgtggggactatggtcagaggctagcacagagctgtccagccaggaagcagagatcacaccatgataagggttttccatccgtccctgtccctggtcacccctcacccttcatggcttcagcagcctggatgagctcagtgacggaaccagccacacgctttgaatgtcctgtcaactgctgcttcagttctgggcttggcttctgcagggtctgggcaagaagcgggcaggggacaaagagcatcacatcttagggtctaccctgatctatgaaatagggcagaccatggccccctcacccctatccctagagcactccacaccatagccctcaaactccacgctgcctatccaagtacacatcatgcatcacacctcacacgtgatagagacagtggggctgtgtcactcaccggctgacaaggagcaaggagaatgatgagatgaaagaggagacgacgaaagtagagaagggggtggtcaggtgggaagggaggagaaaagaaaaagaggaagaggaagaggtgactgggagaaccaaagatgataagaaggatggggcctgggagaaagggagacttggaaaggagaacagatttgggaagtagagggtggggtagggaggagatctgagcaaaacagacagcagggtgcgaggcctgcaggaagagggctgtgtattcagggaggctggtatgaggaacaagcaacgccctcccttaccagcagtacatggtccagcagttccaggtagccattggcacactcccggccatagtgcagggctcgaagccgcacatcaggggccacttctgggtggtaagctgcttcctgtccccagagtaatatgttagctttaggccccgcagatccctacagtttctctcccactatgttctggcccaaagctgcctcacggaaatgcctcaaggatttctaccttgcaagcccgaagcatatctgcaatagcacggcggctcagattggctgtggcaatgacatcttcctggcgacaggaattgccagcagcaacggccttggcggttgccatggtgatacccttggtcattcggatgaagtcttctggggtagaggtcttggcaggtggctctggggaacagaaaacctgtgggggcagaagaagaagaaagattttacagtggctgagactatgagacagcgtagaactctgtgtgcatgtgatttggtgcagacattcacacatcacagtgaatgtaacaaggcagttggttattgtttctgactgaagcaactggggagtttgtttgtttgtttgaaatcacaaaagtaattacaaaagtggcttttggctgggttttcattcccaaaatagagagaagccttgaaggggtgagaggcagagctaggccataaaagatatacagatgataggagggcattttaggtaaatggtaggacatgaacaaccaagatgtcacatcggaaagtatcaaggaatgttctggaatataggaatggtgaagaaaaggttattggggacttgaatatcacaccgaggaacttggacttttacataatatgtgaaagtcataaaatattttgatgtacgggttcaatctgcaaacatttattaaagatcagctaggtggcagattctatgcaaggggctagggatgctccctgttctcatggagcttacattctggttttggacacaggtaataaataaataaacaagcagcaaaactgaggactgtgatttggattatgagagaatagagacagtgctgtgatgagaactacttcaaataggtggtcagggaagggctctctgaggaggtgacattgaggctgaagcctgatgaactggaaggagcacagtgttcaaaaagctggagagaactgagtggaagagcctgcagcagataagagcttggcatgttctcagaactgatggtgcagggggatggggcacagaaaggaagagagtaggatgagactggagaagcaagcagagccatcactaatgggttttaagtagtgaagtgacataatctaatatatatatatttcttgctctgtcacccaggctggagtgcactggagtgatcatagttcactgcagacttgaacccctgggctcaagggatcctcctgccttcagactcatgagtaactgggacaggcatgggccaccttgcccagctaatctttaaattttttgtagagacaggatcttgctatgttgtccagactagtcttgaactcactcaagtgatcctcccatctcagtcttccaaagcgctgggattttacaggcatcagccagcatgtccagactctaatttatattttaaaaacataattttagctactgtgtacaaaggaggattggagggggcaagtgttgaagcatggtgactggatagagactactgcataaatccagttaaggactgatgatggtttggacagtgtggtagtggtaggagataaaaagaaaaaatgagctgtatttggaaggggcactagcaaaacttagatgtggggaatgagagaaagagagaagtctaatatattgaagctaggtttctggctttaggaactgagttactaagaggtgccatttactgagatgggggaagaccaggaaaggaccaggtatgggaggcagaaagtcaagagttccaacttggacatcttcaagtaaaagtgaaaacagaaccttagaaagatgcatttagaaattagaaagatgagtagggagagaggagagtggcagggaccagaagcagggagaccagggagaaaactggtgccacagccaaattgcgggagagtatggaagtgtgaaccagagtgcggacagggaaccagggaggaggaatgaaaggacgtggcaacagcctggatatggtggctaagatggtgaagtcaaagatgactgaggtggaatcttcatgactgcaagggtgttcccaccattaggaggaccatgtcatggttcggaggcactgcatctaggtggtgatgtcaaacaggcagttgaaaataactcaactcagaactggatgtctgcttcttacagaataataatgaaagtggttaaacttgccaaagaagagaagagagaaggaagactatttgtacaaccctgggaaggcctccacatttactaagttaaaggtgattcaatgacgttcgagaaacaagagaaaagccagtatctaggccaagggaagaaagaatttcattttttttcttttttgtttttttttgagatggagtctcactctgttgcccaggctggagtgcagtggcgccatcttggctcactgcaacctctgcctcccgggttccagcgattctcctgccttagcctcccaagcagctgggactacaggcgcgtgccaccacgcccagctaatttttgtatttttagtagagacggggtttcaccatattggccaggctggtctcgaactcccgaccttgtgatccacccgcctcagcctcccaaagtgctgggattacacccgctggcctcccaaagtgctggcgtgagccaccatgcccagcagaagaaagaatttcaaagagaggcttgttaacacagtcagatgctttcgaaatattcaaagaggatgaaggccaagaagtggccactgaatgtagcaactaagaagaggccactagtgactggagaaagtgggagggtggtgaaaaaatacagttgtcacatgctaaggaataaacaagtgggtaggggacagacatgaatgtagctcactggcacagtggctcatgagtgtaatcccagcactttgggaggccaaggcgggtggatcacttgaggccaggagttcgagaccagcctggtcaacatggtgaaaccccatctctactaaaaatacaaaaactagccagcatggtatgcacctgtattcccagtgactcaggaggctgaggcatgagaagcacttgaacctgggaggtggaggttgtagtgagctgagatcacgccactgcactccagaaggagggtgtgggagagctggggtaggggaagtcacatggtgactgaggaagatgccatgtgaaatggaaaggtcacccacacctgggagaaatgacaagaggagagggctgagaaggctggaggaggatggctacagagcaagacccttctcaaaaaaaaagtctggcgatagatgagagagaagactgtgtgtgactccagctgtgagtatatgtgtggcacaggttcacaggctttcaggatccctctctctgaccctagtcactgatgccccagactctcactcaccgccagctcctgccgtatgtgttctgtggttgcctccagggcccgagtgcctttggtggcctcatcttccacggcttttactgtcttaagcaatgatgtcacattggtcaccatcacctggaggtatcagaggagtgaagaggaatgattttaaggaacaggaggaagtatgttaatccagtgcccctcctgatgttgctctcattctctccaaccttggcagagttctttagctgccacacagcagggtcatctccaactttgccagctgcagccttcgttgcactgatgaggtctcccagggctttggctacatctttcactgcgttgattagtaccacctgtgtgggaaagcgttggctctggtctatgggaggaagaagcgggacaggaagtgattccagccggaattaggggcatcaggtcactacctgggtctcagggtcctcagctcccaggctggctgcacccagcttgaccacatcagcgaggcgggtgatggtcgccacggaggactgggcagcctgcgccaacttctcctggctcccagctgcgttttgcaccaggaccttggtgtcctccaccagcaccttcgcagtcttcaggatgccctccctgagggagggcccagcttagtcagatctcccctacccgctccagcccgtccaaggtgcctggtccaggtcttccccattccagcgaatgctatcctgcctcttccagccccgtgccccgacctgtctgcctcccttaggcccagttcctgtcttaccggtggtcagcgaaagtttcagtaccctcacgattgagcgtgccagcagtggcgaacatgatggtggtgtcgaggtcagcaatgataccagacacagcgctggctgctgtgatgcaggcctgggtgccacgattcccagcctggagcgcagccaggacgtgggagacctgggtagggaatgtcacatggtgactgtggaaggtgccatgtgaaatggaaaggttgcccatgcctgggagaagtgacaacaggagagggctgagagggctggaggaggatggcaaaggctacagagtttggaggcagtcccaccatctgcagggatgagcaccgtcaccttctcagagactctccgggcacactctatgagctccttcttggtgtaggcatcactggggctgcactgcagggcgcctgccttggtgaccagagcggcacagccatggcccagctcctgtacccggtgtttgatatgggaacctatctgtgagccaagggaaagacagatggattttacaaggggcactcagggtaccttcactgtgcttggaaaagtcactaaggacatagaaaaaaacatgcattgtagactaaagaagcagagagagaaggttcccagcacaaggacgtttccggttgcatatcctttaggcagaaggtcacctcctacacacagaaaatagtagcacgcaggcactaagtggtgaggattgtgttaagcacagtggggagaaggggaggagcactttatgcttgaatgtgggaatcagagggccgtggattaccatgtggcctgtatggggttatggagggttttaaggatgggcattacatgtgtcctgctaagatccaattacttgctttcttggaaagctagaggcttaggtaaggaagagcttcatgagtttgcaacaagaaagaacaagaacatggactggcagcacaacagagaagcagctgtaggcccagatgagggtcggcagaagccagaaaggcaggcccgggaaggctccagattctgagctgtttcctttgtacctgtgactgaaggctttgatcctctgtccctacccagagcctcactagtcttcagcagagtggccctgaggctgttcccctttctatgaaagaccagagagggtgggggtgggacagccctagacactgacacatcaggaacaaggggcagggggcagggcagagttgcctccacgtttacctcttcattttcagcagccaccgctgcaggcttggcctccgaggccagacggccatagtcactggtcagctggttagcaagagggcccagctcctctgggctggtgtttgacttggtaacctggtgataatggaacgagtgaagttatatccaaagtcagctctccgagggcagtcctctgggactcgcccaaactcaccatctcctgaacggtcactgcaatggccttggctgtccgcaccatagttgtttggtaatccacgaaggaaccttctggttcacccattggtccttcatctagctgaggggggaggatagggaaagggaaagactgttagggtctctgccactgtgcttggaggctctggcccagggtagcctcagtgtccaaaggcaccccaagactctaacctggttgatggcctgggtgatggagtccaccatgccacccacgaccccagcagcactggctgcctcgttgagggttgttgtcaggtcctctacggcctcggtcatcatctgcacagcctcctccagggcttcctgggtgtgagctgcttgctgtggggagaggagaggagctctgttgttcctgtttctccagcctcctgctagtaacagctcctccctcccaaccctcaatacctttgggttaccaccagcctccttggcagtgtatagcaactgcagggcagactctgccaatgttttagtctggtccaggagtgccatctgctgcgggtggctcagggtcttggaggcagcacccactgcagccagggtgagcggctcaaagtactgcgccatctgggacacctgaggcaaggggttggactaggggtcaggtcccctctctctcaccctactccctgggacttcccatgagtctccataggtaccttgtgtcccagctgggaggcttcagcccgggcagcattggccagcggctcaatgagatgggagatctcttggactgcagtgagcatctgagtgtgcaaggcctggggaggaagtggacattagccctgatggtgacctgcaataggaccctctggctacaaagaactgctcttctgtccataccaaataccctaaccctccttcgcacatcccagcctttgatgtccctaagaagccactccttgatcccccagcttctttgagtctgatatttctcttcctagacacatctttccatataaccctctccctctcacctcttgagagattccctcacggggagcaagctgctggctgactgcagcgagggaagcctggtctaggtcccgtagacaactgttcagagctgcaatggccgtttcacactccagctgccctggagccttgtccctgcagacacatcatgggctccaacaccaagaacatcccctactgcaaggccagcctatccttcccctgtatcctcccaacaccatcccatctcattgcactcaagtgcccatcctccattctgccacaatgtatgccccccagccacactggttccccatccctcaatacctcatgcttgtaattagcttcttgatggagtctgagacagtacgggagtggccggccagcaccgaccagctcggggggtcccggggattgactgcgagggcccgggctgtctggatgagtcccccggcactctctaacattgtcttggcagagatcacaatgggctccatggcagcccgaccctggggagaggggaggcaggaaggtaagtctcaggagtccctggaagatgaggtgataagctggcccatcagttcccccttcacatcgcctcacctcagggctgatctgggcaggaatgctggagaactcagggttggacgcaaaggcactcagattgtccacagcctccagcagaggggctgttgctgctcggcactgggcacggttctcctctgtgaaggccccatctagcgcctagaagtgacagagaggctctcaggacttgggatgcagtcatagggggtataggaagtgaagtccaggtctccttcctgggacttacaggatttggggagaggctaggtggtcagtctgaatagaaagagcttgggctcaggcagaggggatttggtagaaggcttcagagaataactgggggactcgggggagaagataggacaggtcagggagaggctgggaattcaagcaatgggaaccttgatggtcttgacaagattagctgtgctgttggccacctccttggctgactgtacaaactggcgcttggcagtaggattggtggtacgggcagaagccaggcgacagctgttacacagtgcagaggtgtgtttagccacaatggtggctgcagagagcacctgaggagacacatggaagagccacgatgagggcaggaaggaggtgtacatacccaaggaggagccattttagggtcaggggatggagagcaataccctgaggagtcaaaacaggaataacagagtcacctgaaaagtcaagatctaggagacagagatacccaaagatgaactgggcatgggagaggaaagacatactaatggagaaaccataagagggcatgtgggagagtaagctcgaacatctacagagaagttgtgaatttagcagtaactgataaatgatgagacccatggcagaaaaagacagttacccaaaaagaagctgtgtgtgcaaggtcagagatgggtccctgccctctttcccacatgcctcacctccctctactccacggggtcggtctgccctttcccagactcgcctgtggtccctgttcccttgagttacctgggcctgggtacagccaggctctcccaaactctggcaggccatctgaattgcctggtttgcacgggcaaactgtgtgggctccactagcccttgctgtccagcttggctattggggtcagagacaccaaccagatatgcagcctgggaagagaaaagggggtgggggtgaggaataaagattgcaggtgggaaatgaatagtgatagtagggacaaaagagagcagaggtaagtttagagaatagggcttattttccagagttctccatgagtggagatacattagcaaacaatggttacactataaagaagaaaaaaaatactctcctgttttcattaagtatattcaagcatttcagaagattaaaaaagttaataaaaaggaaaactacatagcaagggtttttatccaatctctatttagatatgtttgtgtatgttgggtcttagagtgaaaagtatggcttactgtaagtagcagtaaaacgtttgagagccatatataaatacacacctttgtgcacacaagcaaagcctcttttaaagacagttcaaaactgatgaaggttattaggctaattcacatttatagcacctccatgcgtcagatatttggaaaggaagggaggggttaaaaagccatttttatgatggaaagaacatcctaatgtttgattcatacttcaatcaatacacagtagctttgctttttcctctatgcattttcagaaggtggggggaaaaaaaccaaacaaacaacaaagaggtttagtgaaaccctgtctctactaaaaatacaaaaatcagacgggtgtggtggcaggcgcctgtagtcccagctactcgggaggctgaggtaggagaatcacttgaacccgggaggcggaggttgcagtgagccgagattatgcctctgcactccagcctggcgacagagcgagactccgtctcaaaaaacaaacaaacaaaaaaccaaaaaaacaaaaaaacaaaatcaaacaagccatctagagcaaggcgcctattctgacagggcacagggaggtggtggagatggagggctaggatggtaggctttcagggaaaatagtctgaagtgaactcttatgatgccagtttgttttaaggattcatatactaaagcaaaatactttacagctaataggtagttttatacttgataatgtgggaaaaggcaaagttaagtgataactcaagtaactggaaattttgtcactagtactattttaagaaagtagtgattggccgggcgcggtggctcacgcctgtaatcccagcactttgggaggtcgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtctagatcgcgccactgcactccagcctgggcgacagagcgaaactcggtctcaaaaaaaaaaaaaaaaaaaaaaaaaaaagaaagtagtgattacaggccaggcgcggtggctcacgcctgtaattccagcactttgggaggccgaggcaggtggatcacgagtcaggatatcgagaccatcctggctaacatggtgaaaccctgtctttactaaaaaaaaaaaaaaaaatacaaaaaattagccgggtgtggtggtgagcgcctgtagtcccagctacttggaaggctgaggcaggagactagcgtgaacccgggaggcggagcttgcagtgagcctagatcacgccattgcacttcagcctgggcgacagagcgaaacgctgtctcaaaaaaaaaaaaaaaaaaaaagaaagtagtaataacatgaaaaaatagtttgtataagctaattagtatattttgagaaagccagctggaaaaggcctcacggttgggcagtgtaatcctaaccaaagtaccagggttcaggaattacagaaatcagaactgctggtgttcagtaattgctgacaagtgtctccacttcaggaggaggacaacccagattccatagagttggctttgcaaacataaacttcttgatttatctacaggtatgtcaggctgagagaaaatggggtaaagaaagtaggggccattcaaagaacccatctcaggaaaataacctgtgcagctgcctcggtgaagccacaaagtgcctttgaggctgtggaaatggcatctccaaactctggcaggtttccgttcttggcattttgggagatgccagtcatggcctcgcccagcacctgaggaacagaggacatcaggggagtcagagcatgtcctcagaaccccagggcagcatctggttagctccatcctactgccctctctcctccgagttcctggctgtgctgacctttgagttctccattacactgtccaggcaaccaaagtaggacatgtcattgatgggctggactgggttctccaggagttcccggaccgtctgtgtagggggagggcaaagtgagatccaagacacctccctcaggcccaaaaccagaacacttccctcaacctcaatgccatcagcctgccatgtgtctacctccaattcccgcagggcgttatcacactccttctggccgggtgcctgctgggtgcacatagtgatgagctgattgatgctgtcagttactgccctgggagtgacagaaagttgagtgaaaaggtgaataggtcatcattcctgggtcctatgtaagtatttatcttttgcctataaccattcctaagccaagaagctctcatgaactgcctgctccccagtctctctcacacagtccagggctgggcttctcagcaactacttacctggcagctgcagccagctgactcttgaggttaggggcagcagggtccgtggacagggccttggcagccagaagaagtttgcttgaagacatggagatgcccttcaagttggacacaacttgggctcggtcctcctggctctgttgaaggtgacaaggtcaatgcattgtcctgtcctttcttatctgtctctaaaagggatcttctttcccagacactcaagtagtgctagagactggggagggaagggagccaggagcaagtcaggactggtcactcaactgcctcctatctaacccttagtgggaaccattcaaccagaccctctgcctcttcataccggagcctggcctgccatctccacaccagcttccaggaaggtgctgaagtcctgtccaaatcggcctgaggctcgagccaggtcctgaggggttccccgagaggcctgcaccagttctgtggctgcctgattcagcccagcagcagcttcattcaaccggctctgagcttcttgaaatgtcccagtgctaggaggaagctgcaaggtgagaggggaagtcagacagaagagtggggaatgatgcagggagaagtctggtaaaggagggctgaaaaggtgggcacatagcctgggagtaatgaaaggggacagatctgggaagtcagggtcaaaggacaaccgagagggaggaaggagaggcctggcattctttgactcctacgttcccccaccccctaccgtcctcctaccgagtcactcaggagtcgcttgctggcatctccaactgccctcagggcattatccacatcgcgctggccaggtaggcagctgacacagcggttcagagcctgggtcactgctttagccacctggggtgagaaaggagacagggttgcccaagtgaaaagaatttgagagatcgcctccattcacgcgacatgggagatgactagctctactgcctctgaaagtgaaaaaagaaagggggcgttgtaggtgaacaggctgaggttagggtttcaagtgacagtaattaaacttccccaaacttggtgtttagctcagcccatgactgaatccaactgagacacttctacaagaccaagagggccgggcacagtggctcacgcctgtaatcccagcactatgggaggccgaggggggcagatcacgaggtcaagagatcgagaccatcctggccaacatggtgaagccctgtctctactaaaacaaaattcaaaaattagctgggtgtggtggcgcatgcctgtagtcccagctactagggagtctgaggcaggagaatcacttgaacccaggaggcggagactgcactgagccgaaattgcgccattgcactccagcctgggcagtaagagcaaaactctgtctcaaaaaaaaaaaaaaaaaaaagactaagagaacataagggtggaatccacagaggggctgtcaagagcagacccaagaagacatcactctgtgagtgtggacgaggctcagaagctttggcctcaatcagggtgggccttatgaaggaacctgggggagagggagtggccctttcccagtatctgacctgggcaagccgctgctggctctcagggtcccctggatggccagctgcctttttcgcctcctcaatgaggctgctggccttgtccagcacatcactggccgtatcaagtacaatggcctgcactgcaggatctgacgtcagtgcagcgactcccctagcggcctgggccagtgaccgcagcccacctgccacatcccgagctgcaataccttgggagatgaggagaaagagggaagggaaggtgctttcattgccaggccctgattccagtggtttcgtctgtcagtcccatccctcatccagctcccattttcctacctccctcacaatatgccccatgcctggctctctgcccacatacctgcataattctcattgccctgggcaacctctcccagtagctgggcgatggctgagctcacggctttggtgctgttgcccaggtcctgggtacacttctccatctaaggatgaagggggaagaattgggcttgagaaaggagaaggtgaggagaaggaacctgagaaggtacttggggacaggtggcaatttaaataaatgttttgggctgggtgcgatggctcccacctataatcctagcacgttgggaggctgaggcaggtggatcacctgaggtcaggagttcaagaccagcctgggcaacatggcgaaaccccatctctactaaaaatacaaaaattagccaggcgtggtggtgcatgcctgtaatcccagctactcaggaggctgaggcaggagaatggcttgaacccaggaggcagaggttgcagtgagctgagattgcacaactgcactacagtttaggtgacagagcgagactccatcaagaaagaaaaagaaataaaagaacggaaaagaaaagaaaagagaaaagaaaagaaagaggagaggaaaggaagaaaagaaaggaaggaagaaagaaggaaggagagagaaagagaaagaaaaaaggaaggaagaagaaagaaaagaaaaataaaagagagaaagagaaaaaagaaaaaggaaggaaggaaaggttttgagcagctctggggcacggaggtgaaggaagactttaggatttgagtaagaatgaggtcttaaacatacttactgtctccccaggtaagggtttaagcttgccatctcgagctgctgccttcacttcctgtagatctttctctagattctgtaccacactcagtgcagaatccatctccaaaggtccacatgcttcctgagcctatgataagaaaggggttttgggtgtagaaggtcctgctgtgtctcaccaatgcctctgattacacaattatctgcgtattgggttattctgcacagatttcctctcatcacaggactccagcctcatcttccaaagccagaaccagcttccataccttctgggcagccgtccggagttcagccagcgcggtgcccaggttcttggcacactgactcagctgcatggctgaagcctggtcctgaatcgttggcactgaggcctttgcagctgccaccatcttcccacctggctgttggggaataggcaggtggatgaagtgtgccatcctccctctgggcttgggtacaaggactgatgatggtcaggatgtagggaacactggggcttggtattgggaaagaggctcttggcagagattcaaactgtgggagatggaagcttagaaaggtgggaaggtcaggtcagagaagtgcagagggggtgccttgcctgcaggaagctctggctggcagcaatgagggcaagctgagcgctggggctgtcaggctgggcttggcttcctcggacgccctgcaccagcagtggaatctgctctgccactgcctgtaggtgaaaatgtcataagagacccacaagtctccctcttccactcccacatccttcctagagtcttaccttgcagctctgcaccagcaggggctgggggccggcagaggccttgggggtagaggctgcgtgctgagctgcagcgatggtctgtgtggctgaggctgcagcctgcttggctgcatgctgtgaagacaagagtagtcagaccaagcccatggattcccatgcccagcccagtccctggcctaccttgcccaggttatgcctcaaggacgtattaacttactctccgcacctccctttcagttcattcctcccacagcacccacactctctcttgctcctggtgaaactcccagcctcacctccaggcgctgcaccagctttttcttgatggcattctgcgcagctgcattggtggccatgcgcagcccctcagctgcctcccgcagccgctgctgctgctcctcactgtcagggtgggcagctgctccctgagggagaggtggaaagacagtcatcacccagctctcctgtggatcctaaagaagctcctctctcactcctctagactcagtttaaaattcatgtattttcctgaagtcatctctaactagccccaccaaaaggcaatcacctttgagaggagctgactcatgaaggtcaatgggaaacctcagggggctaggattcccactggatgctgaaatcctttcttaaggtggaattgttttgtcttcccctccttggggaataccacacgagtgaggtgagtagggcttcctggacaaaggaggactcagtttagagcaggcatctcaggaataccaaagcaggggacctgcttactcctgccaactgaaaagccccagagtccagggggcctaggaatcatctgggcttctttctgatggttctctgcatgctggtgtctcagtgtcctgctggcagcagaggccccagagactgaatgcctatgtgtattcacaggggagaccaggaaggaaaggaatcccaggcagggtagcagcaaagaaggtaaaaataggccttggacttaagaccttggacttaaagaaaaaggatctggttgcctactacagaggaatgggagagatttattaaaggacacaaaattatagctagataggagtaagttctagcgttctacaccactgtaggatgactaaagttaagactattatatagttccaaatagctagggggaggatactgaatgttcccaacacaaagaaatgataaatatttggataaatgatggatatgttaattactctgatctgattactatacatgtattgaaatgtcactatgtacctcatgaatatgtaaaattatgtcaattaaaaaataattttaggccaggtgtggtggctcatgcctgcaatcctaacacttcgggaggccaaggtgggaggatcacttgagtccaagagtttgagaccagcctgggcaacacagtgagaccacatctttaaaaaaaaaaaaaaaaaaaaagcctgggtcatggctcacccacagccttggggctcattcatttcctgagtgctcctatatttgtcctcttgtgttttctgcttttcctgggtctccctcatcagatgagggtgaccatctggactgctctacttccctctagggtccagtctgggagtgtgcacagaaggctttgtaccttggcagcctctaccatcttggctgtggcatcagctaggatcttggcagcacttaagagcttgcgggagttctccagatcactttccccctcagcatcagccttgatggcattgaccaggtcagatgtggcttgggccaggatgcgggcctgtcgcaccatctcccctgagagcatagggcacagtcaggcgaggaagccagagacactgaggtgtcaggggtggggacaaaggtggggaaaagtggtgtagacaaggtagatgggggctttagggacagaaaaagagactggcaaaagctcttgcatcatttctttggggctattttttttctgggtttaggatcttggagaaaaagattctccagtgggttcttacgggagaaggacagtctccaatgggtattttcagccagtagccttgagaagatgagacactctctgaaaacttttggggtcaggggtatagtagggaaggctataccactttcatgtcactttctatatatttttgtgcgtactttggtatattctttaaatgctccagggaaggtagaggacttaatattccttttacagaaggggaagcagagggttcagagagctttaatgatgagcctatggttgtgtggctggcaagcccacactgtgctgagttccttggggtgaagtggttaggtccgcaaggggatgatgtccagtgggcttagggaaccctggtagggttttttgttttcctgggggtgcgtgtcttaccagcatcacccatggagctaaagatgttctcagtgacggttaggatggtgtcagtagcctggtcataacggccagcaggcccagcccctgtggcatgggctttcacatgctgcagcagctcatttagggcctgggtgacagctgtggctgctgctcctacccctcgcaacagttgcccatcctctgtagctgcctgggaggcagacacacagccctccacggctttggctaccagtcgtccagcctccaccagttgctcttggcagacaggtgagctgattgtaggtgccaccacctgtaggtaaagtgaatgtcagagacgtaggcaagggaaaggaggtagagtatgctgctcatagcagtaactgggatgggtgaggaggcctccagagccaaagaaataaaatgaaaggctcacgtgtgtgtggtagtattacccctcagcacggactagagcaacctttggggctcaccttagtacaggccactagttgggaagtggatagggcacactgtgttgctgcagcaataacttgggtctgaagtcccgagtcctctgtccgctgggccacactcttggccttgaggaccagggcagctgcagcacttgccacagctttggcgagctgcattagcgcatcctgtgagaaaacagcagttagcatgacctgagattgggcttgggattcacagacacttctcagaggcgtaagctgcttcattattcccactgatccaatcaaaggagagtgtacgcagaagcaaccagaacctaccccgagctactgccctgagcacccagcaggacagaacccccaccgaggaacaaacccacaccaagagaaaatacagcctacaccaaatggagacacacatgaggcggatacactcgatgatgacggggagacaatgtggtggcgctgttacaatggggtggggagaggaggtaggaggtatctcctgggatccctccacccccagcttctttactccacttcttgatcttggattggaagtggtcatcctggagtcttgggagcaagtccctgtactaccctacctgatcccatttcccaaagcctggcttcgccaggcctcctcatctcccaccaagttctggtcccccaggag

SEQ ID NO: 13375 - DNA, 462 bp, Homo sapiens
taggtttcaacagtaaagtctttgtttttcttcatagtattatactggagaacagtaaagtctttaagttttaaattttgggaagctgtgaagctcatgtagcaaatacaagtgttccaaaattcgatttttcacttgaaagcttgaattatatcattggcaacaaacactgtcagatttttccctgaagtgacagactcactttgttcctttttagaaaagttctgccagctacctaaatctgataaccacagtttgtcggccattcttttgagtaaacgtggcattccataaaagagcagctagttcagctcacaactcaaagaatggcctaagttatttcctccagaaaaccatcatactttggtatgcaaaatgtcttatgcatacttcccactttatcagacagaatgttgaaaagccttttccttaaggattaaggtttaattaaattaatacatt

SEQ ID NO: 13376 - DNA, 4150 bp, Homo sapiens
tggtaattgtgacactgtggagctgtccttctttgatgtctcagtcactcagtaagccatgtaatttaaattgaccctctgagtgaccaagttgctctgaaaattttccaagtacatgttacaatgagaatgagagaaggaggagggaaaggcggggacatcatgaaggtagaagaggaggaggtttagaatcaagcacaaagagggctcaaaattacgtggaaattggggctggtcagtcagttagccaggggactaatgactttatgcctgctactctgcagtctaccatcattagggacatcttaaacatagaaaggaaggaacacccaatttcacttcaggcacccagccacaggaactttcctaaggttgagcctttgcgttgaaagtgagaccgttatctaaggattcctctccacaccctgattcctgaggagtgttcaaagactcagaaacaatgacaggcctgctgctgagctttgctgtctgcagtaaatgaacgttcagcccttgccctcctgacctgcttgtctttgtttctacagaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcaggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttatacctatttcttacaagtgcaagatgactggctttactatttgaaaagtggtgtgtgtatcatatcatatatcatttaagcagtttgaaggcatacttttgcatagaaataaaaaaaatactgatttggggcaatgaggaatatttgacaattaagttaatcttcacgtttttgcaaactttgatttttatttcatctgaacttgtttcaaagatttatattaaatatttggcatacaagagatatgaattcttatatgtgtgcatgtgtgttttcttctgagattcatcttggtggtgggtttttttgtttttttaattcagtgcctgatctttaatgcttccataaggcagtgttcccatttaggaactttgacagcatttgttaggcagaatattttggatttggaggcatttgcatggtagtctttgaacagtaaaatgatgtgttgactatactgatacacatattaaactataccttatagtaaaccagtatcccaagctgcttttagttccaaaaatagtttcttttccaaaggttgttgctctactttgtaggaagtctttgcatatggccctcccaactttaaagtcataccagagtggccaagagtgtttatcccaacccttccatttaacaggatttcactcacatttctggaactagctatttttcagaagacaataatcagggcttaattagaacaggctgtatttcctcccagcaaacagttgtggccacactaaaaacaatcatagcattttacccctggattatagcacatctcatgttttatcatttggatggagtaatttaaaatgaattaaattccagagaacaatggaagcattgcctggcagatgtcacaacagaataaccacttgtttggagcctggcacagtcctccagcctgatcaaaaattattctgcatagttttcagtgtgctttctgggagctatgtacttcttcaatttggaaacttttctctctcatttatagtgaaaatacttggaagttactttaagaaaaccagtgtggcctttttccctctagctttaaaagggccgcttttgctggaatgctctaggttatagataaacaattaggtataatagcaaaaatgaaaattggaagaatgcaaaatggatcagaatcatgccttccaataaaggcctttacacatgttttatcaatatgattatcaaatcacagcatatacagaaaagacttggacttattgtatgtttttattttatggctctcggcctaagcacttctttctaaatgtatcggagaaaaaatcaaatggactacaagcacgtgtttgctgtgcttgcaccccaggtaaacctgcattgtagcaatttgtaaggatattcagatggagcactgtcacttagacattctctgggggattttctgcttgtctttcttgagctttttggaaggataattctgataaggcactcaagaaacgtacaaccacagtgctttcttcaaatcatatgagaaatactatgcatagcaaggagatgcagagccgccaggaaaattctgagttccagcacaattttctttggaatctaacaggaatctagcctgaggaagaagggaggtctccatttctatgtctggtatttgggggttttgtttgtttttgctttagcttggtgaaaaaaagttcactgaacaccaagaccagaatggatttttttaaaaaaatagatgttccttttgtgaagcaccttgattccttgattttgattttttgcaaagttagacaatggcacaaagtcaaaatgaaatcaatgtttagttcacaagtagatgtaatttactaaagaatgatacacccatatgctatatacagcttaactcacagaactgtaaaagaaaattataaaataattcaacatgtccatctttttagtgataataaaagaaagcatggtattaaactatcatagaagtagacagaaaaagaaaaaaggactcatggcattattaatataattagtgctttacatgtgttagttatacatattagaagcatatttgcctagtaaggctagtagaaccacatttcccaaagtgtgctccttaaacactcatgccttatgattttctaccaaaagtaaaaagggttgtattaagtcagaggaagatgcctctccattttccctctctttatcagaggttcacatgcctgtctgcacattaaaagctctgggaagacctgttgtaaagggacaagttgaggttgtaaaatctgcatttaaataaacatctttgatcacaaaa

SEQ ID NO: 13377 - DNA, 2038 bp, Homo sapiens
agaatctttggaagaactaccagaaacgagtgggaaaacaacccggagattcttctttaatttaagttctatccccacggaggagtttatcacctcagcagagcttcaggttttccgagaacagatgcaagatgctttaggaaacaatagcagtttccatcaccgaattaatatttatgaaatcataaaacctgcaacagccaactcgaaattccccgtgaccagacttttggacaccaggttggtgaatcagaatgcaagcaggtgggaaagttttgatgtcacccccgctgtgatgcggtggactgcacagggacacgccaaccatggattcgtggtggaagtggcccacttggaggagaaacaaggtgtctccaagagacatgttaggataagcaggtctttgcaccaagatgaacacagctggtcacagataaggccattgctagtaacttttggccatgatggaaaagggcatcctctccacaaaagagaaaaacgtcaagccaaacacaaacagcggaaacgccttaagtccagctgtaagagacaccctttgtacgtggacttcagtgacgtggggtggaatgactggattgtggctcccccggggtatcacgccttttactgccacggagaatgcccttttcctctggctgatcatctgaactccactaatcatgccattgttcagacgttggtcaactctgttaactctaagattcctaaggcatgctgtgtcccgacagaactcagtgctatctcgatgctgtaccttgacgagaatgaaaaggttgtattaaagaactatcaggacatggttgtggagggttgtgggtgtcgctagtacagcaaaattaaatacataaatatatatatatatatatattttagaaaaaagaaaaaaacaaacaaacaaaaaaaccccaccccagttgacactttaatatttcccaatgaagactttatttatggaatggaatggaaaaaaaaacagctattttgaaaatatatttatatctacgaaaagaagttgggaaaacaaatattttaatcagagaattattccttaaagatttaaaatgtatttagttgtacattttatatgggttcaaccccagcacatgaagtataatggtcagatttattttgtatttatttactattataaccactttttaggaaaaaaatagctaatttgtatttatatgtaatcaaaagaagtatcgggtttgtacataattttccaaaaattgtagttgttttcagttgtgtgtatttaagatgaaaagtctacatggaaggttactctggcaaagtgcttagcacgtttgcttttttgcagtgctactgttgagttcacaagttcaagtccagaaaaaaaaagtggataatccactctgctgactttcaagattattatattattcaattctcaggaatgttgcagagtgattgtccaatccatgagaatttacatccttattaggtggaatatttggataagaaccagacattgctgatctattatagaaactctcctcctgccccttaatttacagaaagaataaagcaggatccatagaaataattaggaaaacgatgaacctgcaggaaagtgaatgatggtttgttgttcttctttcctaaattagtgatcccttcaaaggggctgatctggccaaagtattcaataaaacgtaagatttcttcattattgatattgtggtcatatatatttaaaattgatatctcgtggccctcatcaagggttggaaatttatttgtgttttacctttacctcatctgagagctctttattctccaaagaacccagttttctaactttttgcccaacacgcagcaaaattatgcacatcgtgttttctgcccaccctctgttctctgacctatcagcttgcttttctttccaaggttgtgtgtttgaacacatttctccaaatgttaaacctatttcagataataaatatcaaatctctggcatttcattctataaagtccaacctgtaagagaaaa

SEQ ID NO: 13378 - DNA, 2038 bp, Homo sapiens
agaatctttggaagaactaccagaaacgagtgggaaaacaacccggagattcttctttaatttaagttctatccccacggaggagtttatcacctcagcagagcttcaggttttccgagaacagatgcaagatgctttaggaaacaatagcagtttccatcaccgaattaatatttatgaaatcataaaacctgcaacagccaactcgaaattccccgtgaccagtcttttggacaccaggttggtgaatcagaatgcaagcaggtgggaaagttttgatgtcacccccgctgtgatgcggtggactgcacagggacacgccaaccatggattcgtggtggaagtggcccacttggaggagaaacaaggtgtctccaagagacatgttaggataagcaggtctttgcaccaagatgaacacagctggtcacagataaggccattgctagtaacttttggccatgatggaaaagggcatcctctccacaaaagagaaaaacgtcaagccaaacacaaacagcggaaacgccttaagtccagctgtaagagacaccctttgtacgtggacttcagtgacgtggggtggaatgactggattgtggctcccccggggtatcacgccttttactgccacggagaatgcccttttcctctggctgatcatctgaactccactaatcatgccattgttcagacgttggtcaactctgttaactttaagattcctaaggcatgctgtgtcccgacagaactcagtgctatctcgatgctgtaccttgacgagaatgaaaaggttgtattaaagaactatcaggacatggttgtggagggttgtgggtgtcgctagtacagcaaaattaaatacataaatatatatatatatatatattttagaaaaaagaaaaaaacaaacaaacaaaaaaaccccaccccagttgacactttaatatttcccaatgaagactttatttatggaatggaatggaaaaaaaaacagctattttgaaaatatatttatatctacgaaaagaagttgggaaaacaaatattttaatcagagaattattccttaaagatttaaaatgtatttagttgtacattttatatgggttcaaccccagcacatgaagtataatggtcagatttattttgtatttatttactattataaccactttttaggaaaaaaatagctaatttgtatttatatgtaatcaaaagaagtatcgggtttgtacataattttccaaaaattgtagttgttttcagttgtgtgtatttaagatgaaaagtctacatggaaggttactctggcaaagtgcttagcacgtttgcttttttgcagtgctactgttgagttcacaagttcaagtccagaaaaaaaaagtggataatccactctgctgactttcaagattattatattattcaattctcaggaatgttgcagagtggttgtccaatccatgagaatttacatccttattaggtggaatatttggataagaaccagacattgctgatctattatagaaactctcatcctgccccttaatttacagaaagaataaagcaggatccatagaaataattaggaaaacgatgaacctgcaggaaagtgaatgatggtttgttgttcttctttcctaaattagtgatcccttcaaaggggctgatctggccaaagtattcaataaaacgtaagatttcttcattattgatattgtggtcatatatatttaaaattgatatctcgtggccctcatcaagggttggaaatttatttgtgttttacctttacctcatctgagagctctttattctccaaagaacccagttttctaactttttgcccaacacgcagcaaaattatgcacatcgtgttttctgcccaccctctgttctctgacctatcagcttgcttttctttccaaggttgtgtgtttgaacacatttctccaaatgttaaacctatttcagataataaatatcaaatctctggcatttcattctataaagtccaacctgtaagagaaaa

SEQ ID NO: 13379 - DNA, 2256 bp, Homo sapiens
tcttcctcacggtgctccagctccacacaccgtactgagcctcgccagccaccgtacgcgaggtcgcggcgcgtccgtgacgtcactgatgtgcgcttctcccgcactaagggaaacatggctctagcgcggccggtgcggctcttttccctcgtgactcggttgctcctggcgccgcgacggggcctcacggtccgcagtcccgacgaacccctgccggtggtgcgcatcccagtggctctacagcggcagttggaacagcggcagagcaggcggcggaacctcccgaggccggtgctggttcgacccggaccgctgctggtttcggcgcggcggccggagttgaaccagccggcgcgcctcacactgggccgttgggagcgcgcgccgctagcctctcaaggctggaagagtcgacgcgcgcgtcgggaccacttctccatcgagcgcgcgcaacaggaggcgccagcggtgcgaaagctctcgtctaagggcagctttgctgacctgggcctggagccccgtgtgctgcacgcactacaggaggctgcgcctgaagtcgttcagcccacaaccgtgcagtctagcaccatcccctcactacttcgcggccgccatgtcgtttgcgccgcagaaaccggcagtggcaagactctcagctacctcctgccgctgcttcaacggctcttgggccagccaagcctggactcccttcctatccccgcgccccgaggcctggtccttgttccttcccgagaattggcccaacaggtgcgggctgtggcccaacccttgggccgctccttgggcctgctggtgcgggacctggagggaggccacggcatgcgtaggatcaggctgcagctgtccagacagccttcagcagatgtgcttgtggccactccaggggctctgtggaaggccctgaaaagtcgactgatcagtctggagcaactctccttcttggtgttggatgaggcagacacactgctggatgaaagcttcctggaactggtggactacatcttagagaagagccacatagcagaaggcccagctgacttggaagaccccttcaatcccaaagctcagttagtgctggtaggagccacatttcccgaaggtgtaggccagttgctgaataaagtcgccagcccagatgctgtcaccaccatcaccagctccaagctccactgtatcatgcctcatgtgaaacagacatttctgagactgaagggagcagataaggtggccgagctggtgcacatcctcaagcatcgtgacagagcagaaaggactggtccctcaggaactgttctggtgttctgtaatagctccagcactgtgaactggctgggatatattctggatgaccacaaaatccaacacctaaggttgcaggggcaaatgccagccttgatgagggtaggaatcttccagtccttccagaagagctcccgagacatacttctctgcacagacatagcctctcggggcctggacagcactggtgtggagctggttgtcaattatgatttccccccaacgctgcaagattacatccacagagcagggagagtgggccgtgtggggagcgaggtgccaggcaccgtcatcagttttgtgacccatccctgggatgtgagcctggttcagaagattgagctggcggctcgccgaaggagaagtcttccaggactagcatcctcggtgaaagagcctttgccccaagcaacctgattttgacaaatctgattaaaatgtgatgctagaacagggatctttcccagtatcttgagtgggtgaccacacttgtcagtgggaggctctgggctgccctgtcggctccttgagggcgggatgaactgctttgtgacttggaaaggtacgctgctggccagcattggagaagaagctgctgagcatggctttctgtagtctttagcaagacacaagtggattttgactttgtatcatgtcatgatttctaacaataaatgatgtttttatgtgcctcccctaagaataattagcaccggggcggaattcagtagtttctgaggattcatacaccaaacctccacatctaggacaaaggctctttcagttgatgttttcatttataaacatttagtttgtatttcctgcccccaaaaaggtatccattaagcccccagggaaaggaaaggaaaggaaatgtgactagcagtagacagagttactctctaacaatgcccaagacaaacgggcgtcttg

SEQ ID NO: 13380 - DNA, 394 bp, Homo sapiens
gggagtagagagtgaaccttggcttaaaaggaaggaaaataactgtgaagaaaagatgacccaacttgaaataaaacctgaagaccttatctcccacttgagagagagaagaagctgaaagccatcagcttgcactctgggctcacagacagagagggtgaggggttgagcccagatctatgacttcagacccctgtctcggcccctaggcctgatcattcattcaaactctcaataaacacggattaccagaccctgcgcagggaacacatctgggaaaacagctgcaacctcggataccagcacgggacaagctatctcagggcaatgaggaacaactaaagagaatcccaggaaccaggtaaccaatcgccagaagccctccgccctcatg

SEQ ID NO: 13381 - DNA, 5144 bp, Homo sapiens
ccggctactcctgctcagcatggctgctttagggactgttctcttcagtgagtgggtatagatagggaccgtggactcgggggccctttggggacgggcacaggacccctgatccggctgcgcggcctctcccccaactctgctctgttctcccagcaggtgtccggaggctgcactgcagcgtagccgcttgggcgggcggccagtggcgactacagtgagtcctgggatgagggcacctgggggaccagaagctgggctaggtcctcacagatctgtttttctccacacaggcagggactggctgccaacccctccggctacgggccccttaccgagctcccagactggtcatatgcgggtaagcgctgatctggcagttaactccactggggagattttcacctagagggaacgcccctggacggggagctgggggtatcaaggtgggggcgtgtaaaagtgtttaactttttatttggaaaacggaatttggggaaagaaaccctcttgtttattttgtagattgcatttcgactaaggaaggtaaagctaaacaggatcttggcttgtggagataagcagaagataattctgacttggggccgccagggtggaagggggtgacaagacttctgcgtttttcaaagggggacatttttttttaaccaagaaccacttttctctgtggttagtgaattttcagtatttggtaccaaatgcagggagagctctttgaaaagctgcagaaataagcgtctcagaggggtagaaggatgaagactatggatggcaggctcccttcagaaaattcttttacctttacttacaaaagagagagggagggagaataaatattagccctagaagggagaaccttagagaagttgaagctactccccattctccttatgagactccagtgtacaagtaggaaatttgaggcctacagaagtgaattgcacatgatcatacagctaggtagtagcaaatccaggactagaacataggccagtcctccttgacaacacagagatctgaatatttaataccctattgttgctctctaggggtatgatcctgcttaattggataattggtgactgaggaagatggtgaagattttttctacttgttatttactgtaagaagcctggcatctccttgtagtagtatggactattggaaagactctggaattacatatgactgcttttttttttttttttttttttttgagatggggtcttgccctgtcacccaggctgaagtgcagtggcatgatcatcgctcactgcagccttgatctcctgggctcaagcagtcctcccacctcagccccccaagtaggtgggaccacaggcacacaccaccattcctggctaatttttttttttaacttttagtagagacaggctcttgctatgttgcccaagctggtcttgtactccttagctcaagtgatccacttcagcctcccaaagtgctgggattacaggcatgagccaccacgcccagcctatggaccttattcttaatccaggcttcccttctcgctaagtttgtggtcttggacaaattacttaattttatcttagtctcagtttccatatctgtaaaagaatacctatctcatgtggttcttttaaggataaaatgaaacaaccaatgtaaagcatgtggcatacacaatattggttccccttcctggtaaataacacctcttctctgtcttgccttcaaacttttgggcagagttttcactctgtttctttctttgcggaaagtaaactacttgggttagatactgcatcttttcagcaagtcagcaggtatttatggatttttattaacatgcttatgtgtctacactatactgtgaatagcaaaagctagcaacacagtccctgacccaaagaacttaaagtctaactgggacaaagcatggactttttaaaaattaagtaatagtattcagggccatgcatctacagttccagatactcgggaggctgaggcaggagaatcgcttaagcccaggaggcagaggttgtaataatctgagatcatgccattgcactccagcctgggcgacggagcgagaccttgtctcaaaaataataataaataatatttcaatactctgcgcctttccaaaaggacctgaggtagctaaataacacttaaaaaaataaaacagaagagtacagtaaatgtcccaaggcaaataggtgaatattaaatattcagtacttctttcagaagagaaggctgatggacttgaagagatgagcgtttctgggaaagttagggtttgagtggacctaaggatgaagatttggctggaagaaaaggaaaagagggcatttcattgtggagtgggatggaatttagcaaaggtacatagaacaacagtgatcacattgcttaagagtttctggttttttttgttttttgttttttttgagatggagtcaggctctgtcgcccaggctggagtgcagtggtgcgatcttggctcactgcaagctcagcctcccgggttcaggccattctcatgcctcagcctccctagtagttgagactacaggcgcccaccaccacgcccggctaattttttgtatttttagtagagacagggtttcaccgtgttagccaggatggtctcaatctcctgacctcgtgatccgcctgcctcagcctcccaaagtgctgggatcacaggtgtgagccaccacgcctggccaagagtttctgaagacaaaacagtagattcagcattgcagaggacctcaaatacaaggctagtgagagttcagtgaaatagagtagtaaattagccgggtgtggtggtgcgcacctgtaatcccagttactcgggaggctgaggcaggagaattgcttgaacctgggaggcggaagttgcggtgagctgagatcatgccattgcactccagcctgggcaacaagagcaaaagtctgtctcaaaataaaaaataaaaaaggccgagcacggtggctcatgcttgtaatcccagcactttgggaggccgaggcaggtggatcacgaggtcaagagatcgagactatcctggccaacttggtgaaatcccgtctctactaaaaatacaaaaattagccagggatggtggcacgtgtttgtagtcccagctactcgggagtctgaggcaggataatctcttgaacccgggaggcagaggttgcagtgagctgagattgcaccactgcactcctacctggcaacagagcgagactgtctcaaaaaataataaataaatgaaataaaatgaaatagagtagtaatatgtctaggagcttattctgggttatcgtacctcacccttgaagatgatggacatattttaggataattaagctacaatgtatatgaaatggaagagaggagctagagattggttcttcccttattcctatcacagtatttgcacaaggtgatgcagtccatctctaacacttgacttttctctcacttctacttgtagatggccgccctgctcccccaatgaaaggccagcttcgaagaaaagctgaaagggagacgtttgcagtgagtggttagagcaacagccagggctacctggaaggagaacatttaaatcataatttgtcttgagctgtgttgcacctaagcaaacatgtacccctcatacagaggttttattaataacagccaaaggttttttttgtttttgtttttgttttttgtgagacggagtttcgctcttgatgcccaggctggagtgcaatggcgctatctcagctcacttcaacctactcccgggttcaagcgattctccagcctcagcctcctgagtagctgggattacacacgtgtgccaccacacccagctaactttgtatttttagtagagacagggtttttctatgttggtcagactggtcttgaactccccacctcaggtgatccgcctgcctcagcctcccaaagtgctgggattacaggtgtgggccaccatgcctggccccagccaaaggttttaatagcactgtgagaagggaggaagagagtggggcactcccaggacaggaaccagtagtagacatcctgctgcacattttgctgtctccctctgcttcccaagccagaactcgctcccactggggagtcagcagcgtcattttccagatgaaacctctgaatttgtaagtggaaggatatatagtatagcgctgaagtcccagatgttatccacactgttttcctgtctgtttcagagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagaaaaagagctgggacaccaagaacaagctgttagatcactgcctgggaggcttggcttagtactctcatctctggttccattccagttcagctaagtcttgctttaaaatttttacctcctagctgggtgcggtggctcacgcctgtaatcccagcactttgggaggctgaggcgggcagatcacaagatcaggagttcgagaccagcctggccaacccagcctggtcaacatggtgaaaccctgtccctactaaagatacaaacaattagccgggcgtggtggggtgcgcttgtaatcccagctactcaggaggctgaggcaggagaatcgcttaaactcgggaggtagaggttgcagtgagccaaggtcacaccattgcactccaacctgggcgacagggcgagactccgtctcaaaaaaaaaaaaaaatttacctcctttgcaggccataggactagcccaactatgagaaatagctgttctgtgaacgtgaaaaggggacagcagttttcccagttttggccaggcagtcaagcctttaacagctcatgcacagtttaggccatgtacagctggcatctaataaatgttttcatgaaaaaga

SEQ ID NO: 13382 - DNA, 5144 bp, Homo sapiens; identical to SEQ ID NO: 13381

SEQ ID NO: 13383 - DNA, 187 bp, Homo sapiens
ggttcaagcaattctcctgcctcagcctcccgagtagctgggattacaggcatgtgccaccatgcctggctaattttgtatttttagtagagacagggtttctccatgttggtcaggctggtctcgaactcccaacctcaggtgatccgccagcctcagcctcccaaagtgctgggattacaagtgt

SEQ ID NO: 13384 - DNA, 11183 bp, Homo sapiens
gggaaccagaccccagttcgccgactaagcagaagaaagatcaaaaaccggaaaagaggagaagagcaaacaggcactttgaggaacaatcccctttaactccaagccgacagcggtctaggaattcaagttcagtgcctaccgaagacaaaggcgccccgagggagtggcggtgcgaccccagggcgtgggcccggccgcggagcccacactgcccggctgacccggtggtctcggaccatgtctcccgccccaagacccccccgttgtctcctgctccccctgctcacgctcggcaccgcgctcgcctccctcggctcggcccaaagcagcagcttcagccccgaagtaagtgagcttcccggcccttcccggagtcgcgcccgccgggaggcgagcccgggggtctcctaggggacagcctctattcggagaggagggcttttgggatctccgctgctcaggcctgcaggattccccctccctttctttttcctcttcgtctccaaacttccagatcgatccaacttttgcccgcttccaaccagctgcccccaccccctgcgccgccgactctccttcccattccttcttttttcccagtccttggaagaactttacaactggggcgaactcccccttccccgattcccttgggctctgctctcagctctggaaccgcctgataaacatttggactccgctcaaaccccgcgctgtcccggctcctcgtcatgcgcgagagtttgttgtttcttcgacttcccagctctccagcgctctcccgccggcgcgccctccgatgggcgcttcggcctccccgggtggcccaggccttcagcggacgagtctgcggccaggtgggggtcgagggtggacggccgagcgtccagggccacagcccccgtctccccgagaggaccccgctgtgtccctacccgcatccctggcgtcgagggtcgcagcgccggcgcgctggccgcgtttccgtacacacaaagctctccttgtgagccgggcgatcggccgggtcgctgcctccccctatccccacccgcgtcggcgccttcaggccctttttgttgttaatagtttttctgtgttaattgcagggagcctgggggcgtcgcttggggaatggggagagggtctggtccggggtgccctcacgtcggggctggctcgggcgccccccaccctcaccccggcccagacggtggcccaccgggccccagaggaagctgcgtgggagttgtctgaggaggtttttcctctctctctcttattttggggtgaaggtgggagacggatttaatgagcttcttattttgggccatctcaacccactcagcctggcaagggcctgggtgcggttgggaggggccaggaagggccctagaagggggatgggatatgggtttggcttctcctccttggtcccaccccggagaaaactctttggaaagaatactgtcttctctctgcgtccctgaaagggtctggggccgactggaaaagtatggccccaggaatcggggtggaagacgaaacgtggagtgctcagagaccagggagagtaaaaacctgccctggtgctggaggctgagcctgactgtccgggaggagtcgtcctcttcccaggcctagagtcctctgagacctgaaagggagcgcccctaacaaaacgagcctgagcatctggggagctgccgaccgccaacttcactgccttaccttttttccctcccctgctttgctgggtcccccaggggaggggcggctgccctggctccgttttaattgggtcatgggcggtcccagtgccagaaccaccatttgcttctgggcccaggaagggagggaggagcagccccagaggctaggatccagggcctactgcagagctggaggtccccccaccctcccctggacccctaagccaaggtgggaggtgttccgttgactttctcctaggggataccttgcatctctctcattcgcaaagacaaagccagccgactgggttctttgacccaacatagttgcttttttctccaggccaatgtggagggaaagctggggtggtgcaggcctcatgcagctgggtccctcctaccaggcctccagagtcctgcaccagctccaggacagccctctcctccccatggcctgtctggcgctgggcccttcctcccacccagccgcagacacaagagtcctctcttctgtggtttcgacctcatagtctctgtgaggagagaaacttgcctaggcctggggggaggagagggatgggggcacttcctttccaggccttgcggctctcttgactccagggaagtccttcatttgactgagccttcatttttctcccgagggtatggggtggaggttgtaggtgtgaatatttagacccccctagcttcttgaacgactccagaggggatttcccccagagctcctggatgtggattctccccatctcttctgtcccgtcttccttctgtcgttctgtcttctccccatcttccttctgtcgttctgctctaggcaaattctctcagctttgctctctgagggttgacggggcctggcctcagtcctcctgccttccagcgtcagtagaccagtcccatccttccccaagtcctgaagcagctgctcctcaaccaagggtcataagcccggggtgtgtttatcctgcaggtatgctaggggcaaaagacatttcctgcatagttaggcacaggccacagcaggcctccccaggcactggctgtggcatcagccagaacaggtcagggcaagcctgcagctccctgagagcagccccggactggtgtggactgcttggctccctctggtataccaaaggttaaatgtcactccttcctctacccctgaggaggggctctcagagcctcagagctaggtggtgctagggttgttctagccaagactgttggctgggaaaaggctgggttgtttacatctcgggttctagctcgcatcagccttggggggggatcacttcccagaaccatgttgcaattcttgcccctgtgggctcaggtccccagtcagctgctcttgagtcacccccagtccccatgcaagactactgccccatcaccaggacctgagcccagaggtgaaggaccatgtggcaatccaatcctgatgaccttggctaggagatacagcacccaacagcagcctcccccatctcccctccaagatcccatcctgggcaacctacagccgcttcctgaactccctaagaaagcaaagctggagcagggactagagctatctgggtggtgtcttctccccataaaagaatccaagcatcttcatatttcatatataacttggcttgttttacttttttttttttttttttttttttgagacagagtctcgctctgtcacccaggctgagtgcagtggcgggatcttggctaactgcaaccttggcctcccaggttcagcaattctcctaccacagcttcctgagtagctgggattacaggtgcccaccaccacgtgcagctaatttttgtatttttagtagagacagggtttcaccctgttggctaggctggtctcgaactcctgacctcaggtgatctgcccgccttggcctcccaaactgtcgggattacaggcgtcagccaccacgcccagcctggcttgttttactttgaggctttaagaaaatactccattgttcttacaataaaggctgactttctcctcaacagggctttgcagtgtgtgtaccttttaatcaaacaccaaaaacctaacattaatttaatttaaggcaatatgccagcctttatattatgaccaattcacaacatacctgaaataaaatacagtcaccaagtctcctcctccacccctatgtcccacttcctctgttgagaatcttttttttttttttgagacggagtcttgctttgtctcccaggctggagtgcagtggcgcaatctcagctcgctgcaagtccgcctcctgcgttcacaccattcttctgcctcagcctcctgagtagctgggactacaagcgcccgccaccgtgcccggctaatattttttgtatttttagtagagacagggtttcaccgtgttagccaggatggtctcgatctcctgacctcgtgatcagcctgcctcggcctcccaaagtgctgggattacaggtgtgagccaccgcgcccggccactgctgagaatcttaaataggcctttaggttccaagccataggtcagatgctgcttggataaggacagcggcaggatcctggcttcagctggatcacacctcttaccacattccaagttcctagtttcccctcgtagcagccagccttagctctagctcttttttctgccctcctttctaaaaagatctcagctgtgagggtcctggggacatggcactcccatcccaggagggcctcaggtcaagcccaatagtagagctcactcagcctgtcaacacccctccccacacatcatgggcatagcccagtcccaggtggaacatgctatatttgtaagaacactgacatgggggagaaaagtgctagaaggaatcacagctctgagaagacatctcagaaccccattaaaccaccagggctctctctcattttcaagagagctacagccaaaagcctgtttgggcccatagccccgaggggacaagctatagccccgaggggcctgggccagagatcaggtctagcctgggagttcctccagacctgctgccggagccaagctgggaacccactgccctttccttgccaagccaaggctgtatgctgggcattgtcggggaggtagaggcaccctatgggccaggtggggacactctaagccatacccctttccctacaggcctggctacagcaatatggctacctgcctcccggggacctacgtacccacacacagcgctcaccccagtcactctcagcggccatcgctgccatgcagaagttttacggcttgcaagtaacaggcaaagctgatgcagacaccatgaagtaagtgctagaccctggcaggagttctgcctagcatccactgacaatgccagcgccagagatgttcctacctgaatgcctggcttgtgcaccccactcccccatatctcatccccacgtgctgatcctgaccctctcatattcaccctgacctcataaccttggcctttccccacattgacacacagcaagtcttacccaacactgatcgtggagacctttctctttcatacactgcactgatcccaatcctcgcacccaaacccactccagggccatgaggcgcccccgatgtggtgttccagacaagtttggggctgagatcaaggccaatgttcgaaggaagcgctacgccatccagggtctcaaatggcaacataatgaaatcactttctggtgagtccaacaggcaagcaacctttctcacatctggttattatttcctacccattgtgcttatgcagggactcagagaccccctgccccactcccctcagttcctgggaagcatccgtgggagtggggaggaaaatggctctcatccttgagagaggtgtagccatcaagggtgcaccccagtgccagagagccagagcctgaggatcccttgttcttgagacagaggcgttgcgcatgaggtagcaggaagagctgggtcaggcagaggtggctgggccgcgcagtcagacctgggagagtgcagggaaggagaatgttgcccctctttatcctaacacaccccatcctctccccacgtggctggacctcagcatccagaattacacccccaaggtgggcgagtatgccacatacgaggccattcgcaaggcgttccgcgtgtgggagagtgccacaccactgcgcttccgcgaggtgccctatgcctacatccgtgagggccatgagaagcaggccgacatcatgatcttctttgccgagggcttccatggcgacagcacgcccttcgatggtgagggcggcttcctggcccatgcctacttcccaggccccaacattggaggagacacccactttgactctgccgagccttggactgtcaggaatgaggatctgaatggtgagccaagtatccctgggacttactctggaaaaagccaacagtcatttgtaggggtggttcccctccctccttccaaaatctccgggctagaagggaccacagagaccttctgatctaacttctgacaaaagcaggagtcctgtttgagctatttacatctggtcccccctctcacccactgactggctttccagtcaaagacttcaaagcatccttattgcccacttttccagaccgatgtcatgtctcgctcccgggagaaactggggactagagagagccttggcttcccttaccacaggtcttcccgggatcggggtcctgcttccaagcactctctcacctccacccagaggagcttgctgactggctttgtgcttaaataccagataaaaagctagacctcagaatttggccactttggattgaaaacatgggcagcaggcttggaggtgaaaccaaagctgctggtggggaagcagggaggctgagggaagggactcaggctgctatcgtcactgtccccatccttccaggaaatgacatcttcctggtggctgtgcacgagctgggccatgccctggggctcgagcattccagtgacccctcggccatcatggcacccttttaccagtggatggacacggagaattttgtgctgcccgatgatgaccgccggggcatccagcaactttatggcgagtagtctacacccacgcctgctccctcctctgctgcttgttccctcctggtctacgcatttcccctcttttatgccttgcagtctccgcaccgccccctgccaacctgcccctgcctctatcagctccacttttgagcccatcttttgtgtcgcctcccagttggttgcttcagcctcccctagaagcccatccacacctttccaagggtattgtctgcccatctgtctgtccttccgtccccgcctcctcctaagtctgaaatgcccctcgtgttttctgccccagggggtgagtcagggttccccaccaagatgccccctcaacccaggactacctcccggccttctgttcctgataaacccaaaaaccccacctatgggcccaacatctgtgacgggaactttgacaccgtggccatgctccgaggggagatgtttgtcttcaaggtgagaagaagtgggctggtttgaaagacaaaagggccctatgggctgggcatggtggctcatgcctgtaatcctagcactttgagaggccaaggcaggtggatcacctgaggtctggagttcgagagcaggctggccaacatagtgaaaccccgtctctactaaaaatacaaaaaattagccaagtgtggtggtgggcgcctatgatcccagctacctgggaggctgaggcaggagaatcacgtgaacctgggaggtggaggttgcagtgagccgagatagggccattgcactccagcctggacaacagtgtgagactccatctcaaaaaaaaaaaaggcgggggggtactctgtggtagggcggctgggtggaagtgacaacagctggactaaaaactaaaactgaggaacaaacagcagtgcgggagctttggggactgaaccagagacctaggccgcaagacataatggacttttcctgcattgaccggcttccaggagcgctggttctggcgggtgaggaataaccaagtgatggatggatacccaatgcccattggccagttctggcggggcctgcctgcgtccatcaacactgcctacgagaggaaggatggcaaattcgtcttcttcaaaggtaaccaggcactccactttagtctttgggagtgaggcgggtctccctagaggagctgatttcctctaaagtccctagagcctaagttgaacccagacgttgccctcctgtcctccccaggagacaagcattgggtgtttgatgaggcgtccctggaacctggctaccccaagcacattaaggagctgggccgagggctgcctaccgacaagattgatgctgctctcttctggatgcccaatggaaagacctacttcttccgtggaaacaagtaagacctcaaccccttaaccccaggcctccctcagaaaccaccaccaccccaaattccctcagttctggagaaagacccactttacccccaacatgcttccctggagaaggagctggctgagcctctgctgttgcctagaaatgggcagcctcctttgggcaccgtgtgagtgggatgtgaccgggtcattccagacctggtcatttggcgcctcctgcccccagcactgcgcctccaccccagcagccaggcactgtcattagggctactggtggctccttgcagcctgggccctcccttccacccccaccttccgccgctttcagcagcaggtcctcattactcaaaacccctgtccccaccctgtccacagctatcctttgcccactggtggattcggtccgggtcttgcgcctcctgaggacatgcccagtgtccgccactgcccttcctttccccttccccaggtactaccgtttcaacgaagagctcagggcagtggatagcgagtaccccaagaacatcaaagtctgggaagggatccctgagtctcccagagggtcattcatgggcagcgatgaaggtgagaggggcaagggaaggtgtcgctgagagaaggatgggaatagggagttgaggaagagcgggagggaagcctgagggagtgctgtgtggaaaacaacggcgatgataataccacataccaggcgctgggctaggtgcttccacacgtggtgcccattcatccccaccaccttccaacctggtactataagcacccccattttacagctgaggaagctgatgctcacgaaggtggagggaagctcagctgccctcacattaacagagcttccctcgctcctctcctctcctctctttgggtcttcccttccttaccaccttctgattcactccctgcagtcttcacttacttctacaaggggaacaaatactggaaattcaacaaccagaagctgaaggtagaaccgggctaccccaagtcagccctgagggactggatgggctgcccatcgggaggccggccggatgaggggactgaggaggagacggaggtgatcatcattgaggtggacgaggagggcggcggggcggtgagcgcggctgccgtggtgctgcccgtgctgctgctgctcctggtgctggcggtgggccttgcagtcttcttcttcagacgccatgggacccccaggcgactgctctactgccagcgttccctgctggacaaggtctgacgcccaccgccggcccgcccactcctaccacaaggactttgcctctgaaggccagtggcagcaggtggtggtgggtgggctgttcccatcgtcccgagccccctccccgcagcctccttgcttctctctgtcccctggctggcctccttcaccctgaccgcctccctccctcctgccccggcattgcatcttccctagataggtcccctgagggctgagtgggagggcggccctttccagcctctgcccctcaggggaaccctgtagctttgtgtctgtccagccccatctgaatgtgttgggggctctgcacttgaaggcaggaccctcagacctcgctggtaaaggtcaaatggggtcatctgctccttttccatcccctgacataccttaacctctgaactctgacctcaggaggctctgggcactccagccctgaaagccccaggtgtacccaattggcagcctctcactactctttctggctaaaaggaatctaatcttgttgagggtagagaccctgagacagtgtgagggggtggggactgccaagccaccctaagaccttgggaggaaaactcagagagggtcttcgttgctcagtcagtcaagttcctcggagatctgcctctgcctcacctaccccagggaacttccaaggaaggagcctgagccactggggactaagtgggcagaagaaacccttggcagccctgtgcctctcgaatgttagccttggatggggctttcacagttagaagagctgaaaccaggggtgcagctgtcaggtagggtggggccggtgggagaggcccgggtcagagccctgggggtgagcctgaaggccacagagaaagaaccttgcccaaactcaggcagctggggctgaggcccaaaggcagaacagccagagggggcaggaggggaccaaaaaggaaaatgaggacgtgcagcagcattggaaggctggggccgggcaggccaggccaagccaagcagggggccacagggtgggctgtggagctctcaggaagggccctgaggaaggcacacttgctcctgttggtccctgtccttgctgcccaggcagcgtggaggggaagggtagggcagccagagaaaggagcagagaaggcacacaaacgaggaatgaggggcttcacgagaggccacagggcctggctggccacgctgtcccggcctgctcaccatctcagtgaggggcaggagctggggctcgcttaggctgggtccacgcttccctggtgccagcacccctcaagcctgtctcaccagtggcctgccctctcgctcccccacccagcccacccattgaagtctccttgggccaccaaaggtggtggccatggtaccggggacttgggagagtgagacccagtggagggagcaagaggagagggatgtcgggggggtggggcacggggtagggaaaatggggtgaacggtgctggcagttcggctagatttctgtcttgtttgtttttttgttttgtttaatgtatatttttattataattattatatatgaattccattcaaatcgttcctttttgttaacaaggggcatggggaggggtgggggtgggggggcagaggcgtctgaccccaggaacctgcagggcggggctgggtcggtgccctctaaggacaattttgaccttgttcaacctttccacaaagaataaattgtgtttcacattc

SEQ ID NO: 13385 - DNA, 6000 bp, Homo sapiens
gggaaccagaccccagttcgccgactaagcagaagaaagatcaaaaaccggaaaagaggagaagagcaaacaggcactttgaggaacaatcccctttaactccaagccgacagcggtctaggaattcaagttcagtgcctaccgaagacaaaggcgccccgagggagtggcggtgcgaccccagggcgtgggcccggccgcggagcccacactgcccggctgacccggtggtctcggaccatgtctcccgccccaagacccccccgttgtctcctgctccccctgctcacgctcggcaccgcgctcgcctccctcggctcggcccaaagcagcagcttcagccccgaagtaagtgagcttcccggcccttcccggagtcgcgcccgccgggaggcgagcccgggggtctcctaggggacagcctctattcggagaggagggcttttgggatctccgctgctcaggcctgcaggattccccctccctttctttttcctcttcgtctccaaacttccagatcgatccaacttttgcccgcttccaaccagctgcccccaccccctgcgccgccgactctccttcccattccttcttttttcccagtccttggaagaactttacaactggggcgaactcccccttccccgattcccttgggctctgctctcagctctggaaccgcctgataaacatttggactccgctcaaaccccgcgctgtcccggctcctcgtcatgcgcgagagtttgttgtttcttcgacttcccagctctccagcgctctcccgccggcgcgccctccgatgggcgcttcggcctccccgggtggcccaggccttcagcggacgagtctgcggccaggtgggggtcgagggtggacggccgagcgtccagggccacagcccccgtctccccgagaggaccccgctgtgtccctacccgcatccctggcgtcgagggtcgcagcgccggcgcgctggccgcgtttccgtacacacaaagctctccttgtgagccgggcgatcggccgggtcgctgcctccccctatccccacccgcgtcggcgccttcaggccctttttgttgttaatagtttttctgtgttaattgcagggagcctgggggcgtcgcttggggaatggggagagggtctggtccggggtgccctcacgtcggggctggctcgggcgccccccaccctcaccccggcccagacggtggcccaccgggccccagaggaagctgcgtgggagttgtctgaggaggtttttcctctctctctcttattttggggtgaaggtgggagacggatttaatgagcttcttattttgggccatctcaacccactcagcctggcaagggcctgggtgcggttgggaggggccaggaagggccctagaagggggatgggatatgggtttggcttctcctccttggtcccaccccggagaaaactctttggaaagaatactgtcttctctctgcgtccctgaaagggtctggggccgactggaaaagtatggccccaggaatcggggtggaagacgaaacgtggagtgctcagagaccagggagagtaaaaacctgccctggtgctggaggctgagcctgactgtccgggaggagtcgtcctcttcccaggcctagagtcctctgagacctgaaagggagcgcccctaacaaaacgagcctgagcatctggggagctgccgaccgccaacttcactgccttaccttttttccctcccctgctttgctgggtcccccaggggaggggcggctgccctggctccgttttaattgggtcatgggcggtcccagtgccagaaccaccatttgcttctgggcccaggaagggagggaggagcagccccagaggctaggatccagggcctactgcagagctggaggtccccccaccctcccctggacccctaagccaaggtgggaggtgttccgttgactttctcctaggggataccttgcatctctctcattcgcaaagacaaagccagccgactgggttctttgacccaacatagttgcttttttctccaggccaatgtggagggaaagctggggtggtgcaggcctcatgcagctgggtccctcctaccaggcctccagagtcctgcaccagctccaggacagccctctcctccccatggcctgtctggcgctgggcccttcctcccacccagccgcagacacaagagtcctctcttctgtggtttcgacctcatagtctctgtgaggagagaaacttgcctaggcctggggggaggagagggatgggggcacttcctttccaggccttgcggctctcttgactccagggaagtccttcatttgactgagccttcatttttctcccgagggtatggggtggaggttgtaggtgtgaatatttagacccccctagcttcttgaacgactccagaggggatttcccccagagctcctggatgtggattctccccatctcttctgtcccgtcttccttctgtcgttctgtcttctccccatcttccttctgtcgttctgctctaggcaaattctctcagctttgctctctgagggttgacggggcctggcctcagtcctcctgccttccagcgtcagtagaccagtcccatccttccccaagtcctgaagcagctgctcctcaaccaagggtcataagcccggggtgtgtttatcctgcaggtatgctaggggcaaaagacatttcctgcatagttaggcacaggccacagcaggcctccccaggcactggctgtggcatcagccagaacaggtcagggcaagcctgcagctccctgagagcagccccggactggtgtggactgcttggctccctctggtataccaaaggttaaatgtcactccttcctctacccctgaggaggggctctcagagcctcagagctaggtggtgctagggttgttctagccaagactgttggctgggaaaaggctgggttgtttacatctcgggttctagctcgcatcagccttggggggggatcacttcccagaaccatgttgcaattcttgcccctgtgggctcaggtccccagtcagctgctcttgagtcacccccagtccccatgcaagactactgccccatcaccaggacctgagcccagaggtgaaggaccatgtggcaatccaatcctgatgaccttggctaggagatacagcacccaacagcagcctcccccatctcccctccaagatcccatcctgggcaacctacagccgcttcctgaactccctaagaaagcaaagctggagcagggactagagctatctgggtggtgtcttctccccataaaagaatccaagcatcttcatatttcatatataacttggcttgttttacttttttttttttttttttttttttgagacagagtctcgctctgtcacccaggctgagtgcagtggcgggatcttggctaactgcaaccttggcctcccaggttcagcaattctcctaccacagcttcctgagtagctgggattacaggtgcccaccaccacgtgcagctaatttttgtatttttagtagagacagggtttcaccctgttggctaggctggtctcgaactcctgacctcaggtgatctgcccgccttggcctcccaaactgtcgggattacaggcgtcagccaccacgcccagcctggcttgttttactttgaggctttaagaaaatactccattgttcttacaataaaggctgactttctcctcaacagggctttgcagtgtgtgtaccttttaatcaaacaccaaaaacctaacattaatttaatttaaggcaatatgccagcctttatattatgaccaattcacaacatacctgaaataaaatacagtcaccaagtctcctcctccacccctatgtcccacttcctctgttgagaatcttttttttttttttgagacggagtcttgctttgtctcccaggctggagtgcagtggcgcaatctcagctcgctgcaagctccgcctcctgcgttcacaccattcttctgcctcagcctcctgagtagctgggactacaagcgcccgccaccgtgcccggctaatattttttgtatttttagtagagacagggtttcaccgtgttagccaggatggtctcgatctcctgacctcgtgatcagcctgcctcggcctcccaaagtgctgggattacaggtgtgagccaccgcgcccggccactgctgagaatcttaaataggcctttaggttccaagccataggtcagatgctgcttggataaggacagcggcaggatcctggcttcagctggatcacacctcttaccacattccaagttcctagtttcccctcgtagcagccagccttagctctagctcttttttctgccctcctttctaaaaagatctcagctgtgagggtcctggggacatggcactcccatcccaggagggcctcaggtcaagcccaatagtagagctcactcagcctgtcaacacccctccccacacatcatgggcatagcccagtcccaggtggaacatgctatatttgtaagaacactgacatgggggagaaaagtgctagaaggaatcacagctctgagaagacatctcagaaccccattaaaccaccagggctctctctcattttcaagagagctacagccaaaagcctgtttgggcccatagccccgaggggacaagctatagccccgaggggcctgggccagagatcaggtctagcctgggagttcctccagacctgctgccggagccaagctgggaacccactgccctttccttgccaagccaaggctgtatgctgggcattgtcggggaggtagaggcaccctatgggccaggtggggacactctaagccatacccctttccctacaggcctggctacagcaatatggctacctgcctcccggggacctacgtacccacacacagcgctcaccccagtcactctcagcggccatcgctgccatgcagaagttttacggcttgcaagtaacaggcaaagctgatgcagacaccatgaagtaagtgctagaccctggcaggagttctgcctagcatccactgacaatgccagcgccagagatgttcctacctgaatgcctggcttgtgcaccccactcccccatatctcatccccacgtgctgatcctgaccctctcatattcaccctgacctcataaccttggcctttccccacattgacacacagcaagtcttacccaacactgatcgtggagacctttctctttcatacactgcactgatcccaatcctcgcacccaaacccactccagggccatgaggcgcccccgatgtggtgttccagacaagtttggggctgagatcaaggccaatgttcgaaggaagcgctacgccatccagggtctcaaatggcaacataatgaaatcactttctggtgagtccaacaggcaagcaacctttctcacatctggttattatttcctacccattgtgcttatgcagggactcagagaccccctgccccactcccctcagttcctgggaagcatccgtgggagtggggaggaaaatggctctcatccttgagagaggtgtagccatcaagggtgcaccccagtgccagagagccagagcctgaggatcccttgttcttgagacagaggcgttgcgcatgaggtagcaggaagagctgggtcaggcagaggtggctgggccgcgcagtcagacctgggagagtgcagggaaggagaatgttgcccctctttatcctaacacaccccatcctctccccacgtggctggacctcagcatccagaattacacccccaaggtgggcgagtatgccacatacgaggccattcgcaaggcgttccgcgtgtgggagagtgccacaccactgcgcttccgcgaggtgccctatgcctacatccgtgagggccatgagaagcaggccgacatcatgatcttctttgccga

SEQ ID NO: 13386 - DNA, 187 bp, Homo sapiens; identical to SEQ ID NO: 13383

SEQ ID NO: 13387 - DNA, 20348 bp, Homo sapiens
gtaaaaaaaaccatgaatcatttattctttggttgtctacacagacacttaagtactgtatcgctgtcatgcagcggcctgtggaggcccctgggggtggctgggcctgtgtcctgagccctcagccagatccagggggtgcggtgtctggtcatgtccactccaagagcagtagcaccatgtagaaggctgtgagcagggtcccctcggctgagtggcagatgtaggctcactgctctgcagccccgaggggctggccagctcagagtgcagaagagttcctctccatgggtctagtcacccatccgtctgacctggacgctgtcatagctcatccttgggcttcgattcactgcctgagagagactcttgtgcaggttcggggggaccctgctgggcatccaggggctgctcctgggagaggtccatctcttctgggctgaagagcatcttcaccaggtcatctgcctgcaccctgtcctgcaaggacaaacccctgcccattcagagaggcctccgctccagacactcgctatctctcagctgctacttcccaggggacaaggaaggttccttaatggccccaggctcatctccttcccagcaggtcctactctctggaaaaggacagctgaagtggggcccaaggagggaaccaagaactcagcatcgctccctgtcttgacctctttccccacctggatcccgttcacagcaggcccagggaggacaaggcaatgtgaccataatgacagggcgttggagctggtgtcccaagtgctcctttcgtgtctcagccactggcaatgggatttggggaagagaaaggcaaaccaagggcgctctgggaacgggtcaccacagcaccagctgctctcacccgctcgagctgctctcacccgctcgctgtgtcgagggtccagggtgaaccacagggcgatggcacagcgctgccccctggtgacagccttcactccatgtgggttttcagtgcctgaagagaatcccacggctcttccacactgaggctgcacctctgcctaagggggacagaaagggaggggggttgcacaggacaaagactgtaatccactctcagaagagacatgggctcattagggctcacgaccgagggcagctcttcagtatggcttccctaagaccagaactaaagagaaagggtgactggttagaggagtgatggacacgtctcaaagcccctctggatgggggaagggtaccgcccactgggaagcccagttggttatttttgtccactgcactttgggaacatcagctgtagaaaacagactttttatctcccagggacaaggacaagggagcactcaccgtcacggtcttggcatccagttcagtgaaataaaagtttccgccatcgaagtccccatttaggtaaaggatggcgctgggaaaggcagagacatctcatcatggcccttccctgcctccctttcccctgagccttcacctccaggtgctctcaaccagcagcaggagggtggctttgtgtgggagggaaacctttaagaacctatactgatgccgtacaaactccacctttccactctccaccctcgccttagagtcccctgtgcccactcacactaccgttcttgtcacaccacgatatgattccctctttgcctatcttcttatccagcgggtttggggataaaggattggactctgggaacagctagccccaaccagtgtgtgtgtgctagggtggggtagtagagtgcagggcactgtggggcctctgaggagggcacagacctcctcaccctgcacctgccccgcactcacctgtagtcgcggaaggtgtaggctgggggctctttgacacacacgagggtctcggcattcaggatgcagttgtccacgtggactggatgactatcatccttcctctctgcctggacctctggggccaatgtcacacatgttagcaagggagcacctcgggagacggcatagctctcttcttggcaggggaggtgcttcccaaaatgtgtttgagtctacggaatgcccaatgaactaggggggtgtctttggctaagccacaagcctaggggtcaggacaagtctgcaggcttcctaggacagttcttggcagaagtgagcagggtgtggcaagcaggaatgaagggctccaaccaagggcagatcctgggcagaatggcacaaccctggtttgtagctggactttacaaaatacaaaggcccagggaagtgagaatgagggatcaggaggtgggacggacgcagggcagagtgggtcagtcctccatcaggactgcaggagatggggctgagtggcaggaagtggggcagagaagagctggctagcaaagggaaagcatgaacttcagtggggctctggggtggggtgggtggagaaaccatgcagggagaaggtcacgaaagggaacagaccgggctcactgtcaaatgccaggcagaccacgtctttccccaacgcaaacctttggcatgctctatgtaggcaccgtcacgtcgtggtgggtgcctccttctccattcccacttgtccagccagtcaccaggtcctgtccatccacctcctgcaccttcccggggcctcacttctccctcctcccactgccacttcctgagtttagggctttgcccttgtccacagaggtcattgctgaccagcttccctttttggtttgaaatctctccacacacacagcagcaaaatgaatcctttaaaagtcaaggcctcaccacgtccttcactgcttgatgaggcctccctggcctcctggcacctgtgcttgtgctctcccaccgggggcttgtgacacacccagttgtgtgtctgactggtccctttgggtgtgcccagattgtgacagaattccaaacattctgaggtagaggaaagccctctgatctgtgccacgtaccaatggccatcactgccaggggcctgctggaggctccagtatgacagagccggctctgggccacataggatccttgcagcactagctgaacctctccccttcttggacatgcaaaagggaatgtgggtgggcgagggaatgaggaataacctccaggccactctcacttgtaaatcacgaagctctctcacaaatttggtatttaacaattagtaaaagagaatctgccacatagctatggttgagctaaaggataaaaattcccttgaatgtagctctccaggatttggcacctttcttagttcccctgactaccaggctgcacaatgcctccactcctgtgcaaacaccatcccaccacccggagtactccgtaatcgtattcatcctgcaaaactgccattgcttcctctgggaagccttctttttgttgttgttgttgttgttattatttttgcttttaacaagcccttctgttgagggctgtctttcaacagatggcagcgagggagctgctcagctatgtatgaaaccctaacccggaggcaggtcctctatgaatggtttagcaccagcttccccattaaagtgcgttgtgtgacaagtgacgggtggccccctttctggctgcaccccatttccctctgggaagccttcttgatccccaggtaggttgactataacttcctccatgctactgtggcatgcatcacactgggatgccacccatgtatttacattggttccccaactgaagaaaagggaccgcatcctgttctctctgtgtcttcagcatccagcacagagctgaggtacagcatgcgggggcgggtgctgcaggggtaatgaggcccaccttcgatggcagtgcggcacaccagatgagagtaggaaaagtagaggggcgtatccaggcggaagtaggactccatgatgcgccgcaccttctccgtcacgttgtagtacaggtgggcactctgcagaggaactttgccttcttgccccagctgccaaggagacagatggtcagctgccctcaacgactgatatggtttggctctgtgtccctacccaaatcttatcttgtagttcccataattcccatgtgttgtggaagggacctggtgggagatgactgaataatgggggtggatctttcccgtgctgttctcataatactgaataagtctcacgagatctggtggctttaaaaaaatgggagtttgcgtccgggaggtgaggggcgcctctgcccggccgcccctactgggaagtgaggagcccctcagcccggccagccaccccgtccgggagggaggccggggggtcagctcccccgcccggccagccgccccatccgggaggtgaggggcgcttctgcccggccgcccctactgggaagtgaggagcccctctgcccagccacgaccccgtctgggaggtgtgcccagcggctcattggggatgggccatgatgacgatggcggttttgtggaatagaaaggcgggaagggtggggaaaaaattgagaaatcggatggttgcggggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctaatcttaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaaaaataaataaataaataaataaataaataaaataataaaaaataaaaaataaaaaaatgggagtttgcctgcagaagttctctctttgcctgctgccatccatgtaagatgtgacttgctcctctttgccttccaccatgattgtgaggcttccccagccacatggaactgtaagtccaagtaaacctctttcttttgtaaattgcccagtctcgggtacgtctttatcagcagtgtgaaaacggactaacacaacgcccctctttaggggccagagacaatgagtaccaggcccatcccacgtccccacacccccactgaagctgcagcctctgctgcccacgcccaatacccctactatattcctcttcctcctgtccttcttatctctctttatgagcacactgtgcatcctgcacagaagcacagccctctagaatcagcctttctaaagaaagcattctcatagctttggcgaacagtcttatcctgctcactttgttttgattacactcggtctaacaggattcaaaagtgaacctcacgcaacataactcatcctcgcttcctggcaacaagaatgttggcaggtggaccctcttcacctttcctgccaccagccccaactcttcctcaaagcctgagcttcccccttccccacccctttctccacactctagaatgcccagtgttgatcttaccttgagggctttgaagacagtgacaccatagaacttttcattgggagtatgtggggaggtctgaccccggtagccatctcctgaggttgctgccacctacaaggcccaaaacacaaggtgatgttagccagggcagctgagggcttgagaagaggtggtcaactgtggccaggaagaggaaggcgaaggctaccacccaaggggcacttggtggggggatgctggacccttgggggaaggtgcagtcactgggcttcccttacattggtcagtctctgcagctcctgacactcgtggtcagagattacgccgtccatcaccacccgctgggaaccattcaggagtttggagttcatggtgagactgatgccttcatacagcagggggccacctgcaaagcaatgacaaaactctagctaaatctagcagcagctagaccaaagactctccattggatattgcctcctcgtcacaaatagaaattccagctgtttccttttcaccagcaaaatctcccgctaggtcattttcaaaggtagaatagtccagaggacagaacatagagctgaaagatgagattcccagtcccagctccatgaccaaatagctgctggcttttgggccatgacacactcttgaggaaacatcagaaacacaatcctaaaacatgagctcgggaacgaggaagaactgactttgactcctagatcctccattgattagctgtgtgaccttggcaagttacttaacctccctgaggttaattttaattaattaaaatgttctcatctgtcaaacagcatctaccttatatgtttgatgccagtataatgttaagaacaaggaaggcaagttaaaagcttagtacaatatttggcatatggtaagtcctcaaaagtttggctaccatggtatcatcatcattattcatttaaaataaggatcttgcaatctgcatgactcacctctcagttataagaatcaagagaaataacaaagtgaaagtggtctgaaaacaaaggaatgctggacaaattcttttcatacgctaatcttgtttaattaaccactgttaatttaagcaactatagggcaaaggtcaacatttctctcttacagttctcatggtgtttctctgtgctagggacatactaatactagagactcagttcaactccacttgataactgaggcctcagtgtgtaccaggaactgtgccagatagggtgagagatgaatcctagaagacagtacctgttctctaacaattatgcaaataactagcataagacagaccataaatgccctaagaagttcaaaagaaaggaggggactccaatcatctgggaggttaagaaaggctttacggcagggcacagtggcttatgcctataatctcagcactttgggaggccagggcgggtggatcacaaggtcaggagtttgagaccagcctggccaacatggtgaaaccctatctctactaaaaatacaaaaaaattagccaggcatggtgccacatgcctgtaatcccagctacttgggaggctgaggcaggagaattccttgatgatcccgggatgtggaggttgcagtgagccaagattgcaccactgcactccagcctgggcaacagagcaagactccatctccaaaaaaaaaaaaaagaaaggctttgcagggtatatctcagatgccctcatgggcagggatggtgggaagcgtactaggagagccaggcataaacacagactggtgggcagtgggcgggctcacggaacaaagtgcagtcctgtgtgaagagacggtgtaaacaggacaagagtagaacattcggttaaggggcaggcacggaggatgggtcagaggccagtgtctggaagactggcctagctaccttgtgtgggcaggggcaaggacaggccagacggggaaagggtgggtgcagataggaggtgccagggcctgaaggaagcctgaggcaatgaaaaacggaaaaggctggggagagagctgagaagcactgcagagcagagccacaatcagtaggccttcccagcagcttgcagaaaacgggcacaggaggaagaggagccaaaggaggcctgaaggcgttgagtctcagtaaagggacgaatggtgaaaaccgggagaaaacagtttgggagtggggagacaggatgagttaatacctatggaagtggacaacactagtcactcatgtttctgtgacacagaagtctcatttctttctttttttttaaagatgaggtcttgctatattgcccaggctggattcaaactcctgggctcaagcgatcctcctgcctcagcctgccaagtagctgggattacgggtgtgcaccactacatcctggagtctgatttctgagccaaaggctgattctcagtgctctttccagctgaaagtcccgctggtgagttaggaaggatgtccactgaacttgcaccctaagggtggctggctcatggtgagctctgcaatgctggggtggagcgctgcctggcaaatgtggggtgacctgcctggctccctgacaacagccagacatgcccctatttctgtcctctcaccttcccgggtcagtctgctcacatccagtgactccttggtcttctcttccacaagggtctcgatttccttcataaggttcccaatctcctgggagatgcgtacggctgtttcccgttctgacctatgagcacagccgctctgaggactgcattccagggccagccctgggctccaccccgacttcccaaactggacctgcccaccccttgccaggagttcacatctgcctgggctcaggaagcctcaagtgcttcatcagactgatccaaccatgcagtttcttcaaggtcctcacttctgtttctcttgcaatctcttgggaatcacttcttctggagtccatgaatcctaagtaggtcaggaagaaatgaaaaaggtaagatgatctacttaatcttccaggtgtctcaatgcataaaataaggcccacaggagtaatccagcttatcaccctcttcctttcaggagacaaaatgggaggtttccacatctaagtcccttctagctgcccagtgttcccctttcatctgtctctcatccctgccttgcacagatcccaggctaggctcagcctccagcaagttttctctcagaatcgcacagtgttcccctcctccccattcatctctcctgctcactctttccccgctcccttccggctcctgtaccctagctcaccggatccacaaagggaattccaaaaacatcataagcgaagaaaagcagttctttttccagtaggcttcgctgtcggtactccttggcactctgagggtaaaaaagcaaacaaatcccccagaactcagccctgtcttttaacctctgggagttcccctccctggcaccccacactgatgctcccatgtgacctgaggcctcctctccctaccaatgctctctgtctgttccccagtttgagacaaaagtctaatttctgtgtcctctgcctggcacaagcaacagtacctctgaggtactggaataaccaggctttccttaagggaaaaagccctgctcctcccccatcccaacccccattagtctctaggacagataatctgatgattctcaaaagtggaaatattcttcaaagaaggagaattccttcttgacttctacaggagtccacaaagcaggaaaaggaatcaggcattaggcaactgacatgttattcatttgatcttttatagccacatctgaggttgatactagtatgctcattctacagaggaagcatctgaggcacagaggagatgtaccactgtctaaggtgacactacaggacatgggagagcagcgacctacagtcaaacccaggtcttctgttatctttttcttttttttcatagcagaatgtgcatttggacagataaagccgggtctttacagtcctaaagcccatgtgctttctgctctgccacctgcctcctctcagaccctaaccagaccacacccctccctgaggataagcagctaaaggggagggcctggcactctgggcttcccacatggactcccaggcaaggcttacccagggcagggaaactgagtactttccggggtcacatctttccctaggtgccctgctaatctccaagcagcaggaggaggaaggaagagaaaaaggagacatcagttgaaataaaacatgaggcagttcaaggaggaattaaaggagtcaatgaatcctatgtcatctactatatttacctaagaggaagagagacgttttctcttcaggagtttacattactggcttctgtcaccaaatgctatgttatctcatttaaccctctccaatgaccctataaggctgctatgaagcaaaccccacttccatctttattcattcgatgctgatttactgagtgtcagccatgtgtctggagctgtgcctgcactgggtccaagcagggaacagattccggtcaccactgactggccacaagccactgcacaagttacttcatctctcagatgctaacagtcctcatccctaaagtgggaagaagagtgccaaccttgcagggtggctgtgatgattaaatgagatgatggatacagcccaccccgcacagagcttcgcctggacagcggctcaacaaatgttagttgccttctttccaaaaggggacttctagttaaaaatgctagattggccacgtgggtttatttcccctcactcccctcagactccccttaatggccataaggaaggcagggaaaaggtattaaccaaacaagacaaaagagaccggaagtgccatcttaaagccagatggtcaccatctagtggctaaagaggacaactacaatgacaacccacacaggaggggcagcaagaggctgtttctactggaggctctcagactccagagctcggaagaagagcctgggtgtctcctttcagcgcagcagtctttgtgttatacagatatttctcctggttttggagagagacagggaaaatgctgaaagatgggagagaacaaacaatggcaggaagaagaagagatgggaaagaaaatggagacagaaaacaggtgagcagaaaaaaaacaaccagtattaagtgaaaaatgatagctcttggccaaataatatcgagtgtccaagttaggggtgccaagaggggaaagaatatgctcaccgcgcagttctgcgggactcagagaatagacttctgggcccagataacgctaattgaggctcctgtgtactccccacactccctccctgtgctcccttctcctctgaataacaagccgagtgactgaactcacatctggccccaacactgacatctggcccctgccctgcacgcacagcgcctactcccctctgctaccccactcttccgccctcaggtctgagttcagctggcagctgtcataacagaaggaagtctctcacctcacgggggccgatggatctggtgtgttcttctccaagcatagctgcataataggccaaattttggttcatcacctcgtcattggggaagaagagaagataggtcttggcacattcaacagcctgtgtataattcccaactgcaaagtggaaagaagaatggctgagaggaaagagtcaaaaggaaaggataaaatcctagcaccagggaccacttagtgttcagtctccacaaagcttgaggcaatggcagcatgacaagctggtgcctgctacttaacatgatggcctgatttcaggggcaggagttaagtaatacacatagaatgtgtgattaattttaaggtgaggtggtcaatgtcctcagggctgcctaacaatgaaacagaaaagaatcagaattctctgcatgcccacatcttttaagattcacaaataattccaatactccttaatattttgcctcaatacactcaatcattagatcaatttccctgtcttcctaccttcttttttctatagattttcagaagacaaggaagattacaatagcagattgtctctttggcaaaatagttcttgttgatatttgttagtcatctcaactcaactgtaaatattgtacactcatcaatatgtttgtaatgcttagcacacagtagggactctgcaaagagttggttttctgggtattaattggcagccccacaaaagcatcagtgctataccagggagagggctagcaaatgtcctctgagctagtttaaactgtggcatacccttattttgctattaactttaattcaaaagcaaaaatagattacaagttatagaagggacaagagatgaggtcctaagtctccctcccccagctttttgggttgctggtattggcttcctaggccagttgtttataacaaactacccagggatcacttggcatggtgcctcccatagctactgaaataagccaaacaccttgaggaagtaagtggctgtaatccctgcccaccttgcctttagcttcttagttagccagcagagaaagaggaaggaaagtaggccttactgttatagtaggcaaactgcagataattataatgcgatgggaggaagtcttcaaagggcttctctcgacttgggtgggaagcaagctccgtgacacagttctgcttacagttgaggacctggatgtaatgatctgaaaggaatcaaacagaaggaataactatgaggtcactctttagaactcaaattctggttaagatgaacaaattcaaatggaagcaatttttcatcagcttctcagatttaataaattgaggaatgagggtgaagagtccccatttatattatcagatggtgaccttagagtcccaggaggcctggctgaaggtctggctctgaactgcacgcacctgtgatggcctggaagaggtcagcgttgtactcaaggtagttgtagccatcgtagtcatagggcccttcgcagagggcacggcactcctcataggccacaaagtattcttgcagcgccgcctctaggtggggcacagcttcctgtggctgttcctctgagtagagtcgcactcccagtcgaaattcttgctactgggaagaaggagcactcaaatgcaggccacagaggaggaaccctctctccttgccctcagccaccttcacaggggtcctaatttcctgttcctcaggttatggatggaaaggggtgacctgggtaccactataaaatgaaggccttttgtaaatggtctttacaaaatatttagctctggaaatttaaaaacatttagctctttttttctttttttgagacagagtctcactctgttgcccaggctggactgcagtggcacaatctcagctcactgcaacctccacctcctgggttcaagtgattctcttgcctcagcctccctagtagctgggattacattgtgcccagctaatttttgtattttagtaaagacggggtttcaccatgttggccaggctggtctccaactcctaacctcaagcaatcctcccaactcggcctcctaaagtgctgggattacaggtgtgagccactgtgcctggccaaaaaacatttaactcttaatctagatgaaagatatctaggagttcattatgattttcttgtacttttcttccccccccattagtgacagattcttgcacttttttttttttttttttttgagtcggagtttcactcttgttgcccaggctagagtgcaatagtgcgatcttggctcactgcaacatccgcctccagggttcaagcaattctcctgcctcagcctccagagtagctgggattacaggtatgcgccaccacgcctggctaattttgtgtttttagtagagatggggttttgtcatgttggtctggctggtcttgaactgctgacctcaggtgatctgcccgcctcggcctcccgaagtgctgggattacaggcatgagccaccgtgcctggcctaggttcttgcacttttttgtagggctaacagttttcaaataaacacaacttactttttgttttgttttgttttgagacagagtttttttttgagacagacagcccaggctggagggcagtggcatgatctcagctcactgtaacctccacctcctgggttcaagtgattctagcgcctcagcctcctgagaagctgggattacagacatacaccaccacacctggttaatttttgtatttttagtagagacaggatttcaccatgttggccaggctggtcttgaacttctggcctcaagtgatccactcacctcggcctcccaaaattctgggattacaggcatgagccaccacgcccggccaacacaacttacttttttttgtgtgtgtgatggagtctcgctctgtcacccaggctggagtgcagtggcacaatctcggctcactgcaacctacgcctcctgggttcaagcgattcttctgcctcaggctcctgagtagctgggaatacaggcacacaccaccacgctcagctaatttttgtatttttagtagagacagggattcaccatgttaggcaggacggtctcaatctcctgaccttgtgatccgcccgccttggccttccaaagtgctgggatgacaggtgtgacccactgcacctggccacaacttacttttaaaagtcattctttttttttttttttttttgactgttgctctgtcacccaggctggagtgcagtggcacaatcttggctcactgcaacctccaccttccaggttcaagctattctcctgcctccatgtcgagtagctgggattacgggtgcatgccaccatgcctggctaatttttgtatttttagtagagatggggtttcaccatattggccaggctggtctcaaactcctgaccttaagtgatccacccacctcggcctcccaaagtgctgggattacaggtgttagccactgcgcctggcctataagtcattcttatattgtttctaacattcctattttataattaaaatgtaaggaaccataaactctctataaaatgctatatcatcacagacagtccctcctttggaacttttcctgctaaacaaatagaatgagaacattgaaggatactgtaacatttattgtagtgaaaatcaaaaacatacatgaccaaaaaaatgtgactagtgaattaatatagtctctgcataagatggactatcatgcagccataaacaattatgttttcaaataaaactgaagacatgagaaaagactcatgataataatgttagttaaaaaatgatgatggggctggccatggtggctcacacctgcaatcccagcactttgggagcccaaggcagtaggatcgcttgaggccaggagtttgaaatcagcctgggcaacacagtgagaccccgtctctacaaaaaataaaaacaatagctgggtatggtggtgcatgcctctagtcccagctatttgtggggctgaggcgggaggatcacttgagcccaggaggtcaaggctgcagtgagctatgatcacaccattgcactgcagcctggacaacaaagtgagaccctgcctcaaaaaaaataaaaaagatgataaaaaatgcatacatgatataacaccaaattagatgaaaaaattatatacggaagacttaaaaaatagggcaaaatataaactggttttcttaaggtggcggtattacaaatgattactttttattttatacttacctacatttctacaatgttatacaatgaacattcattacttctgtaatgtaattagaaaacaaccttagtaatgtcatttaaaaaaaaacaaaagaatgcatgcctgtagtcccaactactcaggaggccgagactagagggtctcttgagtccgggaatttgaggttacagtgagctatgatcaagccactgcactccagcctgggtgacagagcaagactctgtctctaaaataaatttaaaaagaaagaaagaaagaaggggataaagtttttttcaccatatggggttgagtctcaagatccttgaagtcggcctccttcactccagacatggtttggtaatagtctaggttctgctgcatttccatgtgctcaggattgcccacgaagaaggtgtgtgctgcagcaacagctttctccaacttgttgatctaagaatgaagcatgagaaggtggataatgctcacatccaatctctgaacgtttgtgtccacatgagcagtccacataaacaggaaatccctgcctccctgagccctccactcagcgtgcccagcccctgccagccccaggaagcacacctattgcaggaactacccacgacagattaggagcatagtgccctgggcagatttgtagctctttcccaagtcagatttaggggttccccagattacaggaagtagcaatgttccattttaaaacaaaggtcatattgtatggggagtgctgtgaaagactgactgcccacataatatgttttcatgctgggtgcggtggctcaggtctgtaatcccagcatttttagaggccgaggcaggtggatcacttgagctcaggagttcaagaccagtctgggcaacatggtgaaaccctgtctttacgaaaaatacaaaaattacatggtactatatgcctgtagtcccagctactctgcaggctgaggtgggaggacgcttgggcctgggaagcagaggttgcagtgagccaagatggtgccacagcactccagcttgggtgacacagcaggaccctgactcaaaaaaaaaaaaatacatatatatatttcatgaatcaaatgtaatgcctgagctgaagaaattctgtggcttcaaggatttaggggtagagaaaaaagagcagctaacagactatgcctaagaattttcctagaaaaaaatttttttttgcataaaataaaatgaagaatttttgagacatttagggaaaaggtggatggctaaaaattctaaggtcctttactaagtccagacatagtattttctgactcaaagctcagggctcatgaggttcaaacaaatagctctaagaaatctgagggggtggtcgggggcggtagctcatgcctgtaatcccagcactttgggaggccgaagggggcagatctcttgaggtcaggagtttgagaccagcctggccaacatggtgaaaccccgtctctactaaaaatacaaaaattagctgggcgttgtggcgcacacccgtaatcccagcttcttgggaggctgaagcaggagaatcgcttgaacccgggaggcggaggttacagcgagccgagatcacagcaccatactccagcctgggtgacagagcgagactcttgtctcaaaaaaaaaaaaaaaaaaaaaaaaaaaagaaatccaaggggggagaaataggctacagaccacaatgcccacagcaatggactccagcatgtcaaagtaacacaggtttcatatatagaatccaaccaaataaatcactgatgatctagtaattaactatgtggacactggtatcaaagagaccagccgtggccaggcacgggggttcacgcctataatcccagcactttgggaggctgaggcgggcggatcatgaggtcaggagtttgagaccagcggatcatgaggtcaggagtttgagaccaacaatagctgggcgtggtggcatgtgcctgtaatcccagctactcaggaggctgaggcaggagaatcgcttgaacccaggaggcggaggttgcagtgagccgagatcgcaccattgcactctagcttgggcaacaagagcgaaactccgtctcaaaagaaaagagggctgggtgcggtggctcacgcctgtaatcccgcactttgggaggccgaggcaggtggatcacaaggtcaggagatccagaccatcctggccaatatggagaaaccccatctctactaaaaatacaaaaattagccggatgtgatggcacgtgcctgtaatcccagctactcgggaggctgaggtaggggagtcacttgaaccagaaaaccagaagtcagaggttgcagtaagccaaggtcgccactgcactccagcctggcaacagcgagactccatctcaaaaaaaaaaaaaaaaaaaaagaaagaaagaaaagagacaggccagcatcacatctgggcttaatgactcactgactggctgggcagtagacaagatacttaaagtttactttctaaactcagtttccctaatctatcatctggagatagcattctctagctatctcctagcattgttgagagttcaacgagataatatgcagcctgtaatacatggtgctgggcacagattaagtgctcaataaattttaggtggtatgattaatatgctaagaaaacttattttcttatcattggtactagtaaaggcacactaaaggagtcagccctggttaggtgacccaaggtaaataactccccatctctgtacctcagtttctttaactgtaaaattagaaattttttcaggtctgtccctttcatggaattactctagctcttgtgtctttcagcgctgctcctgcctttctctgttctccctcatgtcctcactcctctctccacccccagccttctttactctctaagcactgaggtacttaacctcctctcttgtggacaaatgtctgcctcctaatcaagtgccaccactttctccttcttccaaggctcattcaccatggcttccagaataagcgttttaaaacccaaatctgaggatggctccctgcagtccgcagaattctcttccaaatctggcctcactgacttttctagccgcctctcctactactccccacacacatctcgacattgcaatcacaagagttcattttttttcctgaatacatcatgctttggttctacttttctctctatctggaggagccttctttcctctccccctggcaatacttagggcaggcttcaatattacctcttctttgaagtctaatttctctgagataaagctagagtctccctcctttgtgctcccgcagccctaagtatatgcccttgcagtagcccttactacagtaactcttaacagcaaagcaagacaaagcaaagacgttagtcgagcatttaattacttgtacaagaactggaatgcagtaggtatgcaatacatgtttgtcaaatagttttagaaagtgctatgatgaagcgacataaccaaagacataacgcaattattttgatttcaagtccagcgctcttccgagtaactaggaaaaatgaggggaactgtgtaggcagaatgctgtggaggggtggaaatctgaggtccccaagagtctctaagtgtctctttagatcgaatcgaaggtcttttaaacaacagatataccagatataatgcacaactctttctccccccacccccaatacagtgggactaataacagcatctacctgacaagatattatgaagattagggcaaatgcgttaataaatgcaaactgcttaaaatagtgcctggaagtatgtgctggctatcatcatcatcatcatcgtcaccatcaccaccaccaaacaagcctggaacgctccaagcccaagtgtacacttggacacatggcactctggcattccgaaaaatactcattttctttgtaaacctggcagactagccagagggtcccccccccgcccccacacacacacagaaagggccaggcagcccctgctggcgacgtggcaacctcacatcctgaaagagagctgctgaatcaaacagcaggaaaagcaccactggaaaaccaaccggaagggagatattgtagaccgctactagcttctcactcggacacttacaatgacatcagaatgggagacccaaactgccgctttaattccttccaggagatttcccagggaacaaaatggccatgagttttgcttggcctgtgccctaaccccaggctggacctttggggttagcatctgcccatgcgaactgggcgaggaaggtctcctgccagggagcagctctccccggctccgaggagagctccccagccaggaggccactttcccctccctgcggacacttccccgatcccccaagctcctcaggtcccctgcaacactcctctccccagaaggaccccggccgcctggttccaggcaggtctgcaccttgaagtaggcgacctgcaggtagttgtaggggctccgcttgcggaactccagctccatctcttcgctgagcgagtgggcggccggcggcccgaggcagcggcgcaggcaggcagcgcgacgcagaaggcccccgaagaagctcaggtcgcgcagggcggcggcgcccgaggcctgggccgggctgggggaccagtcggggtccagctcccacgggaagtcggcggcacactgggtgcggcagcgcaggcgaagggcgcggagggctgcccgggagcgcagcgcccgttccatgctcaggaccaccccgggccagtccccgcgcgcgtaggctgcggtcccctcggcgaagagcagatcaggcgtcaccatgccccatcctgcctcggactcgacctcggcttgggaggcagcggccacgacagccagcagtgtggtcagcagcttcaacgcgcgtaccgccatcgctccctcagacctaacggaaccgccagccacccgccaccaa

SEQ ID NO: 13388 - DNA, 9532 bp, Homo sapiens
gcaggctcttcctactcgcacagcccagggagtggggaggataaggcgctgtcatggaggacgccgccgcgccggggcggaccgagggggtccttgaaaggcaaggagcgccgccagctgcaggccagggaggtatgcggggcgggagtcagcagggggaagtcagctcccgcgaggcagccggtctcggggctccgcgggaggccgacggcgggagctcacggcttgtgttcctgggtgtgtgtcgcaggagccctggtggagctcaccccgacccccggcggcctggccctggtgagcccctaccacacccaccgggccggggaccccttagacctcgtggcgctcgcagagcaggtgcagaaggtgaggaggcgcggccggggcagcgaataaccatcttcgttcacgttgtactctgcgtctttcggctcagacctcactaccacctatggtgggggtggcatttgctcttgtctccattttacagacgagtaaagccgactgtcattgtgagtcggtggcctgattcgaatgaccttctgggaccaaaggttcctctaactgcaacttgagtgcccataatcttccttcgtgggaaggtttacacaacactttagtgttcattatttcatttgcaccttaggacagccttgtgaggtaggcagtacagagttattcttcccatttgacacaaagaaaagttcttcgggaagtttcaaggtccgcttattttaagctgcttcccataagatctttgttacctgagagtttaaacatcttctagcagggcaaggactccaagtttagtcctcattaaacacagtattcccaagcccagtgtttatatatggatggccaaaataagtcaaataaggaggaaatgtgaaataatggaaaaaacactggaagtttggacacatgagtattaatcccacttttgatactaacttgcagtgcgacttaaggcagattacttctctctggacctcaactattttatctgtgaagtgaaaggtttgaagtagtagagctccaagatctaaagttttgtcattattcaatgaaaaaccagattccttcttatctcttatcaagacttccagttgtacaccctcttcagtgtccacagatggagggtcctgctgttttaaagattatcatggccccttatccctgtatacactatcagatttggccttgattatgttccagggtctttgctttgcccaaaattatttaatgtgctcaaattccctcacatctctttttttttcaatgatcctagaaatccttcgaatccttttttttttaaaattaagaaaaattcagatacgcagaaagctcctttaattcaaaacttggctttcttctttttgaagagctggggagcaaagtgcaacttttatttattaagagaatatgcatctagttaatcagattactcttattgggagggaggttggcagggacagaatcttgtgcacacaacgtattcatgtgctattgaatgactatcgtgtttattacgatggcctgaacagatggaagaaagaacacagtttttgtctttcatcctataatcttatgaaatacagaggatgcattattatgctgcctctgtttccccaatacaatctgtatttgagaagctgaagaaaaaaaaaactttagagacaaacaaattgaatcaaacatattaactatctaaaatgtactttttggccaggtgccgtggctcacacttgtaatcccagcactttgggaggccaaggtgggtggatcatttgaagtcaggagttcgagaccagtctggccaacatggtgaaaccccgtctctactaaaaggtgtggtgactcatgcctgtagtctcagctactcgggaggctgaggcatgagaatcgcttgagcccaggagacagaggttgcagtgagccgagatcgcaccactgtactccagaattggtgacagagtgagactcttaaaaaaaaacaaaaaaatgaggctgggtgtggtggctcacgcctgtaatcttagcactttgggaggctaaggcgggaggattgcctgagctcaggagttggagaccaacctgggcgacatgtgaaaccctgtctctactaaaatacaaaaaattagccgggcatggtggtgtgtgcctgtagtccgaagctactctggaggctgaggcgggagaactgcttgaacctgggaggcagaggttgcagtgagctgagatcacaccactgcactccagcctgggtgacagagcaagtctaaaaagaaaaaaaaatggtggtgggctgggtgcagtggctcacgcttgtaatccgagcactttgggaggccaaggcgggtggatcacgagatcaggaattcaagaccagcctggccaacatagtgaaaccctgtctctactaaaaatacaaaaaattagccgggcatggtggcagacgcccgtaattccagctactcatgaggctgaggccggagaatcacttgaacctgggaggcagatgttgcagtgagtggagattgtgccacttcactccagcctgggtgacaaagtaagactccgtctcaaaaaaaaaagtacttttttagcaagactgacccaggtattggtgtgtgttcagaaagctcaggaggcctggtattaaggcatgaattttggaatctgacctgtgttcagatcctttgctgtttattatctgtgaaaccttggacaggttgcctcatgtctgtgagtcttaattgctaaaatgagaaagtgaggttatcatctccagcgtcataaaggtgttgtgagaagtaaatgagatgaatgtaaagggcctcagagtagttgaggccagggttagtgcttagtagttgtaggtactcttcccttcctttcttttttatgaggctcttttgtttttaagttgttcgtgaaatattttgcattttttttgtttgtttcttttttcctttttttggacctcagactaatccatattttgcattttatattaactcttcaaaatataaattcaaattttgtttatgagatttattgctaacaccttaagaaaagggagggttattataaggccacccctaatctggaactaccttagctctagaaatacctactctctccttggccatatatggctcctcctttctttctttcttttttttttttttgagatggagtttcgctcttgttgcccaggctggagtgcaatggcgccatcttggctcacagcaacctctgcctaccgagttcaagcaattctcctgcctcagcctcccaagtagctgggattatagacatgtgccgccatgcctggctaattttgtatttttagtagagacagggtttctccatgttggtcaggctggtctcaaacgcccgacctcaggtgatccatccgctacggcctcccaaagtgctgggattacaggtgtgagccaccacacctgggctttcattcttggaacaaaatgcaaattcttttaccatgggctacaagactgcacaatctggtctctgctctctttttaaaccctgttctacacattgcccatcactaactactcttcagctgcactggcctcaaatgcctgcaaacttttttttttccagcttttttcatggtcggtcctctcctttcatttagacccaagtcaaatgttatatccttggtgaggccttcttgtctgaagaagaccgtaccctaccccatccaaatgacagtattattaaattgaattcaaatacctctaggctacatatactttccaattccccaccactccctattattaaacttcataaaaatgaagtagcttttttacttaactcatttgttatctttaacctgcttctacgacataattgtggttatttccttcataacagtgcattgttatgagtacatataatattagctttaatcatctttactttttggtatctattactcactggagctgtgctttaggtagccactagcaacattatgtctgttaagcacttgtgttacgttgttagtgtggctgaggaaccgaattttgtattttatttgattttaattaatttgaatttaaaaaacctgataattacttcaattattggaactcaagtatattggaacaatttgagtatgtgaatcaactttttcacatataaattttattaagtttaaatacagatgaagtatttctgatgaaaatttagcatccaaattgagatgtgctgtgagtacaaaataaacactatattttgaaggcttaatatcaaatgcaaaatatggattagactgagaaggaccaaaaaaagaaacaaaaacaaacaaaaaatgcaaaatatttcattaacaacttacaaatagtgattacatgttaaaatgaaaatgtttttgatatattaggttaagtaaaatgtattagctgagcacggtggctcatgcctgtaatcccagtactttgggaggctgaggcaggcgtatcacttgaggccaggagttcgaggccagcctggcaaacatggcaaaaccccatctctactaaaaatacaaaaattagcggggcatggtgacgcatgcctgtggtcctagctactcaggaggctgaggtgcgagatttgcttgaacccgggaggcggaggttgcagtgagcctctgcaccactgcattccagcctccgtgacagagcgagactctgcctcaaaaaaaaaaaaaaaaagtattgttagaattaatttactattaacgtggctaccagaaaatttaaaattttatatgcaacttgcctcatatttctgttgaacggtattagacttgacttgcgatcttgacaaaggcagggacttctctttcctgtttgccagtacacccagtgcctagtgtggtgtctgacacatagtagctgcctaatatacatctgtgggacagataaatgactcagtttacttgtgtggtttctgttcactcataacactggtttatacctgaactttgccttaagactcctcaactaaccagcaaattctctttaatatttcttagttcaggttctagtttaatctcctcatttctttaccttaattgtgtataatcagcttttcttaaaagtaaggtggaagtttttgacagaattctattgcctgagtggtaatccttcccagcacatgaatttgtcacattagtctctcctagctttgagaatttgatctattttaagaaatgtcctggctgggctcagtggctcacacctgtcatcttagacctttgggaggccgaggtgggcggatcacctgaggtcagaagttcgagaccagcctggacaacatggtgaaaccctgcctctactaaaaatacaaaaattagctgggcatggtggcgggcacctgtaatcccagctactcaggaggctgacattagagaattacttgactccaggaggcagaagttgcagtgagccaagattgcgccattgcactgcagcctggacaataagaacgaaaactgtctgaaaaaaaaaaaatgtccattgccttcagttgcactttgtggcacgtgacaggtagtcttgtgtgtacattataactctgtttcaggtccacatcataatgcagtcttttaaaatacattttaagtaataattagaaatgcacatataagttaacatttaagtagttgtgatgtaaataactgaggaaatggtcagattaacgcatactttctcagttcagggggtgtgggggtcacacagaaaaacccgaatactttctatgtgtatctagatttctaccttagcagatgataagggccagatcacaagtgtcttttaattatttaaaatccatccctgatttcacaagtgtttaaacatgagaaaatggagacctgagaaatgtgtggtgtttgttaggtaaagagcaggaggaaaaatggattggttggaggagaggatatattcagtatatttggtagcaggagagagaaagagagaaggcatgctggagaaccaaagaagttcagtgtaactgcagttcatagcgaaggggtggaaagctatgggaaatagaagagagcacttaactctgtggcgtggagtcatgtcagggtggccttctcatgacagtgctatctgagtggggcctcggatgagtgggaggctatggggcagtggcaagaatgggaaaaatattttaggcagaagcaaaatattaacataaccctgggatcaagataagaacatcatagaagtcttttcctctttcaacccacagtttagttttttctcacctgtaggctgatgaattcatccgagcaaatgccaccaacaagctgacagtcatagctgagcaaatccaacatttgcaagaacaagccaggaaggtaaggaatgactgttagacaggctttcattttctttatttagttctcaggattggctgaacttgtttataatcgttgtgactttttatgtctttaatacctcctagaaatgtagaggtgttgagtaaaatagaaggaataagcttaagaggttaagtataagtttttgtttgtctgtttgtttgtttttgagacagaggtttgctcttgttgcccaggctggagtgcagtggcatggtctcagctcactgcagcctctgcctcccgggttcaagcgattctcctgtctcagcctcccaagtagctgggattacaggtgcccgccaccacaccctgctaacttttgtatttttagtagagatggggttttgccatgttggccaggcctgtcttgaactcctgacctcaggtgatctgcctgcctcagcctcccttgttttgttttttccaggagaaggtttcatgaggtaaagcatttaacaggggattatgttttcatttataaaagaaatgtacttagcacagaaaaataggaaagaagcttaaaaattacccagggtcattaatgctcaacattttgaaatatctttttttttgagatagggtatcactgtatcacacaggctggactgcagtggtgtagtctcagctcactgcaacctctgccccctgggctcaagtgatcctctagcctcagcctcccaagtagttgggagtacaggcatatgccaccacacctggctaattttttgtatttttagtagagacagggttttgccatgttgcccaagctggtctcctgaactcaagtgatccacctgccatggccttccaaagtgctaggattacaggcatgaatcactgtgcctggcttgaaatataatttttctaaaggcatttttacagcatagcagcatagtctaatttttgtttcttcagaataatctggatctcagaagtgattcattgctatgggggagcaagatcctaagcactgaatggtttccaaattttaattgggatgatcaccaaatgtgggtgcctgttatctccaatacctaatttgttacatatctgtgattcataggtactggaagatgctcacagagatgccaacctgcaccatgtagcttgtaatatagtgaaaaaacctggcaacatttactatctctataaacgggagagtggtcagcagtatttttccatcatttctccaaaggtaagaacatacattgtttgcccaaaaatctactccagcctctgagaaattcttggtatatgtgtgaaaatgtagacatgtggattggtatatggtttcttagaaaattgggggtgatgtgagcccagacatgactctaaaaaatatacctgtgcttaaattatttcactcattttcttcattaagggagggatctgatgtgtaaggtaactgcgttccaaaggttgttctgactagtatgaagtgaaaagccaaaaaagagattgtggcatgattaggaaatgagctcagtttgtttacaacccacgctgatgggaactgcctcctttgccttctctaggaatgggggacaagttgtccacatgacttccttggtgcctacaaactacagcatgacttgtcctggactccgtatgaggacattgagaagcaagatgctaaaatcagcatgatggacacgttgctaagccagtcagtggccctgcctccgtgcactgaacccaacttccagggactgactcactgagagtgggctttgacaaacagctctcacaggacctggctgtcaacctccttgttgcccccactgttgccttgagaattgaagacatgtaggtgactcacaaacttcttggaaagagaccctgtgtgaatgtaaatgctgtcattatgacttttaattgggatgggaataatcattgagacagagtcactgtctttcgggatcctctttggaccacagatacccaagtcagtcagtttcagagtattggccagtgtactttccttcttcctctccatcacttcttcccttaagttaaagtgttagagaagaccttcttcccataaaaaggttggtggatcgttttccagagagaactgttttcagtcttttatatatatatatatatatatataactggtagtatttaacattggggttgaggctgtctcacagttggtgcaactccagtttaaaattcatctgggaacgagaatgttgagtaatggagggtgatttaaaaaacaacaacaacaacaaaaaaaaaaacacttggcttggctggaccagagagtgtgtgattctgggatttctgtgctgttgatgaggtttgtcttgccccttttgctctctctgccttgctagagtgacagaatctgaggcagcaaaggccaggtttggggagagtcaactttgaaactcacaaattttagacttggaagagacattggatgctgccactaatcattatagagtccactgtgtagtctcccaagttggaaatcccaggctcagccacctgcagcagaacaaacccatttaaatggctacttaacactgtggaagagagtaaggcagtagagtgagaagcaagaaaaacagccaaattgttgactgtgagttaactcagattgaaatccattttgaccagaattattcaagaacttaacagggttttggcaaaattactgtagttcttattctgactaggctcttgtaggactctaccttctttcctatctgtttggtggaattagctaagtttatggattatttcgcatggctataatctattgcaatatgctgtaaaaggagggagagatgtgtacttgaactgacaattggccaaatttctctctgggaatgatgttcctgatgctgatctgtttggtaataccctccccgggccgccccccgattcatggtctttcctcataaactgcatttcttgtgagctgtaagaggtctacctaaggcctagcacaggatggggctagaatctaacaaactcactccgatgatacttggttgctcggttcacatgggaatgctctttggactcagctgcagaggtcttttgctcaggtgctgcagagccggatggaagagacattagtggtagagtagtggattctgacta

SEQ ID NO: 13389 - DNA, 6504 bp, Homo sapiens
tcttagaaatggtttattgacaaatggcttctggggagggggccaggattccctcttagctacagaaggttccagggtccagctacaagcagggccctcgcacggggctcacacagagcaaggccactcagctggaatgtggcccctcaacaccactgcgcccaggctcccggacactggacacctttgcaggggtctgggtgtcccctgaggccggggccggcttccctcggggtgctcggtacttgttcttctggccgtagaacaggttcctctggaaaaggtggggaaggcggccctggtgcagcagcacagccaggaccatccctgcaagagaaggcaggtcccaggtgggccgcgggctcctgggcccaaacacagacaggacacccactcccaggcctgtgccaggacaggcgagccaggcagcctggccaggagccccaagaaccctgaggcccagctcctgcctggtcctggtcttcccgccctggtcatgcccctctctctgggtatgccagccatggggacgggggcaagccggtggggttccttgtacttctggaccaccctctgggatgagtgactggaattcccctccccccacattgtcctgagccactcccagagcttctgtggccattttcctccgggacctgatgtggcgtcccagggtggctgcttgcagggctgtggcctggcgtagaggtgggggatgtgagtggacaagaaagatgtggatgcccctgggtgggaggctgggcctggctaaatcctcatgcgaacgttctcccagaactccaggagcagagactcctaaatccccgcctgccttccaggtcattgggaagggcaggtgttccgggcagaaggggagagtagatcctcttcaagtttgatctcactcctctaaggatttaacccacagtgtgtgagctccactagggctggcctgagggggccctgcctgtcaccacctgcagctgctgtggctcctgacagtggcccctgtgcctacagcttgcctacagttgcccctcactcggccctccaggcccacactggtcctagctctgttcccaggagggcaggcccagggaggcgggatgacctgctcaggggtgctgccagcaggtgccggtggccgctcacacccagggagatagccccatgtccacacctggctacggggctcctggctgcagccttggagctccccagggctcatgctgatactgaacttgtggataaaggggttaatggaaggacacaagcctgtttttcggtttcctgaagctgccctaagatgacaggaaagggatgctgtcagaggtgtcaagcatccagatggatgagacgggaagagacgcaggagcacagcgtggggctgacaagcatgtggacgaccaaacactgctgacatggaggggccggatcgcccctccgcagggacgaaagctgggaaacaacccagttcttccgcagatgccccatgctttcagaagctggcgcccgggtccctgtgggatggggtggccctgggactcgcctaggaggagggacggcaattccgcatgggaagctccagggccccaaaccccaaaatacagaagcagccagtgcccccctccctggccctggcaggagacaggttcctctctagagggggcatgtggactcgagtatcaggcccgcccaagcctggagtcccgcctgaaacacggatcccagcctcctcctacttggctcctagaagccgcaaatgccctttgggcttctccacagaggcagttctacagtgagaggttgcagccgggtgaagagtatttccccagcgacacgcccttcccagaacacaggatgtgcccttgttagaatacggcctgggacataaaatcagtgaaatcacggtgacgtcatacttgagtagagtgaacctccaattcgatgactggtgtccctatatgaagagaacagacaatgacacagaggaggcggccaggggaaccggcagacatgggagtgctgcgtctccaagcccggggacaccgggggtgccagaggcccccggagcccggaagaggcaggaggctcctccccagcagcctccgaggagagctgaccctgtcagtgctgccagctcagactccagcctccagagctggctgagcatacaaccctgtcacgtgaagcctcttcgtttgcgtcctttgccttgtagcccgtgaagccaccacaggccatggttggggcctgagaaactcaggacgaaactgagctcccacccggaaccctgcccaggcctcaccgacactcaagtgcaggtcagaaccaggacactatttcagacacaggaggtctgaagtgtacctgccaggtccccgttctcaggaagctactgtgagacgggcaccagcaaaaagaaggaatcaaccgaaacaggaggcgatgaggaaagcaggaaacagaaatacaaccaggatcagtgaagggcagcaccataccggagatggacgcctgcgggtaacccggagctgcggatcctcgggggagacgctgcccacacagagcactggtgctgaactaaggaaagcacccagaagcctgggcaggagagagtccaggacctcgtcacccgcaggaagcaaggcctgtgcaggagcggagaggcctccggggccaccacagctcacccgggccgtgtttccatgccagggaactagagggggctctggagctgatcaggaggaagaggccgacccacccggagtgaaggatccgcaggaggagcgtggggaggcaaggaaagaacatccgccccccacatcccaggagacagcccagggttgatacctgaactgaagagtctcggagaagccctgcaggcccagtgtgtggggacagagaggccaacacggagctgttcctagcagagggcagtgctgcctcggcaacgggggcaggagggggttcctgatgcacttcatatgcttcctaggaccctgcacatgcctgagagactgtgaccacatcagaaccatggcgacaaatcacgatgacgtcagtgtcaccatcgcagggccaggtgcctgagagacccccagctcctgtctttccccccaaggggaggctgaggcattgcccctgagacctccccagtgtagagccagcagaagctgaaaaaagcttccagaattccataggaacccagctgcccttctggtacctcagtgaggtggagccgagtgtctgagagcaggtgcaggagaaggtgtgggctccacctgggcctctgaagccaggggccagaatccccagatctaggtccaagagggggctccatgacctccccatgctgctcctctgcttggatccaggatataagaaaggaggggcacacactgtgggggaactctggggtcccctgtgtgcatcagcgagtcccgggtctgccccaccaggatgcaaagggcctggctgctccagccccatgctcacagccctataagtgcacgatggcaccctatatcatctaagcggggctctctgcctcctgaggctttagggacaccagaatgagcccccctcggcggagtctggctctgggtgtgtggagatgccacctgggacgggaaccccaggtgcatggagccccactgcagacaccatcccccgtgtgcccagcaccccttgcaaggttggcctttccccagcctgtggcctccttacctggctgcagcttgctcggcaccgggacggtgtccacagtgagacatgccgtcacagcccctacccccgaaaccatgcccactgcagagacctccccaggagcactgaccaggcaccctcacctccaccctgcaggaccccacgtgccaggatgctctgtgggccccagcagccctagggaccccaccctgcccctgcccttacctgtcagagggcccagccagtacacctgcacgtactccagtaaggtgtgtcccgagcaggcaaaggtcacagaggcggccagggcagggttgaagaaggcagacgtgaagggcccggctgtgggcagagcacagacagccctggtccccagccctgcctgacgcccctctgcaggccaggacctgatccccgccaccgaatccacaccgagagccccactgtgtgcaggcctgggagctgctctcggctcctgaagccccgcctggtcccccgcaccgatggacacacgatgcagcaaggccgggtcagccaaggtctgggtcaggggcagcagcttggggccccccagggccgtccaacaccctcgcgacatctcaccgggatcccgtgccccgcccatgctgccctccagcaccccaccctgtgggatgtggccttcgagaaagacggacagagagagatggagagagacactaagagagacagatagtgagagagagacaaaaagacacagagagagacagggagacagagagagaggagagacagagagagagaggagagacagagagagagaggagagacagagagagagaggagagacagagagagagaggagagacagagagagagaggagagacagagagagacagggagacagagagagaggacagacagagagagagaggagagacagagagagagaggagagacagagagagagaggagagacagagagagagaggagagacagagagagatctcagaaataaacgagcagcagcagaggagagaagacgacatggctgtgcgatgtgagacaagggaaggcggcggcagccgggccgctgtcctgcagccccaggcctgggtgaccaccccaaataacagaatccaccaataccggggacctgcctctgggcacggaagagcagggagtgggcctagcggagggcagggaccacagggacatggagtctgcggccgcccaggtgtaaaccaggaccctgaggatgggcagctccgtccctgagaccaggcgccctgtgcctcgtggaggcaggacccttgacgggagctctccggtgccacccaggacagaggcccgggcaatctgccacagagccgtgtccctgcagagctcccgctcacccgtgcctcagtttccccatctgtacagggctctggtggcaccttcctgtggcctttgtggtccagattccgtggtgtctgcccagtgctgggtcgtgggcagtgccatggacctaagtgctggtcctgtcctgattaggacctcggacccccggaaggagacctggcaccattctccctgcagcccttcctgtggtgcctggagcacgagccggctcccctggctctccctgcagccccagcgctgtggacacctgtcctgggaacttgctgagcaaaggctttcgtggtggtggagcctagcgctcggaggggaaagcagacatgggggactggatcagacggagggtctgagtggagggagctcacaagggggtgatgggaccatgagagctgggtgccacggtcggtccaggtgcaggcagagatcgcaggatgcaggtgtcagtaggaggccagggaggccaactggggcaggtgagacaggacctgtcgctctggaaggggtgatagagggtgcagggactcccacaccagaccaggaaactgggctgggccttgaatcgtctgcctcggctgtccctactaccccagaggcagaacttctgggaggaccaagaatagctgcgactggggagaggtgcagtgggcaggatggccctggcaggggacaggctgctccaccgcaccccatgtccagcgcaggccctcgtctacccgccagatcccaggaaatcaccgcctcttcttgtgggtttgttggccacccgggccagcagccccctatcctgggtgcaaacgggcctgagtgtgcatggaggccacacaggtgagaggtcctcaggggcccaggggaaggggaagcagtgctcacccgtgtaggccgtgacggtgaccaacagagccacagcgggcccgctgtaggcgggaggactgtgccgcaggtgcaggagggtcagatggaaacaaaaggcgcaggcggcctccacaagcgccccgtggggcacggatgtgcgcagggccgagctgcagctctgggccatgaggctctgcagcaggtgcaggtcactgagctcccaggcccagcagaggcgcatcagggtgcaggcggcctgcatgcccagcccctgtgccgccagcttcaacagcgtgccaggcagagactgctcggccatgaggaactcctgcagggacacagtggggttggccgaggccccgtccaaggtgaccccgtgcgccaggaagagcaggaagagcagggtgagcagcaggtcaggcccaaagtccccagcccagggcccgagctcgaccagcgtcctcatctccaggcagcagggcccgagctgcacccgcacccaccgcctcccgggcgaagacttcataggcgcccactgggagcagggccttggaggcccgcc

SEQ ID NO: 13390 - DNA, 397 bp, Homo sapiens
tcgcaaaacaaggggcgattttatttcagctttgaactttccaggtctggggttcagaatttcctccagttagggaaggtgtctggtcgcctccaaggaggggaggccccaggctcttcgactcccacaggaaggccgcctgtccccctccccaacccatccactgacctcttcccaggaggcagagaaaccctggttccagtagggctgtggctgccttcggctgcctgttccctgtgcaagtgccctgccctctcagaggagcagaggaaccttctggaacctgtagaggcctggcatctgcacagggaaaagccaggctttccctcgtgggatcctgtggagaatgagctcagacggattcctcatattctaatccgacaccactggagacctt

SEQ ID NO: 13391 - DNA, 8261 bp, Homo sapiens; identical to SEQ ID NO: 12829

SEQ ID NO: 13392 - DNA, 280 bp, Homo sapiens; identical to SEQ ID NO: 12830

SEQ ID NO: 13393 - DNA, 802 bp, Homo sapiens; identical to SEQ ID NO: 12831

SEQ ID NO: 13394 - DNA, 10309 bp, Homo sapiens
actgccagcgaggagctcctattattatttgtaaagcttgtgggaagaggaccatctcctaaatgctttggactggtctcgtacttgttttctgtgtgttactttgagatacagattcatgacggcgctcagattttattttactttttaatgtttcatgacacccattctaatgttgatcatttcttctcagccacagaacagcctggttcactgcacagttcccagggacttgggatgggtcctgtggaggagtcctggtttgctccttccctggagcacccacaagaagagaatgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacagcaaagaccttacgagaattttcagaatacagagggaaaaggcactgcttattccagtgcagccagtcatggtaatgcagtgcaccagccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacaggtaaatgggtcttcgatagtcacaagcttgtctttttttatttttcagaaaatacagcaaccaagcagctctattatagattgtgggttataatggggacagagggcatcatcagctgccagatgcaaattgcccctgtggaatggaccctgccaaaccacttggtctgggagtatttcatctggggctaggattcatcacagatgcccgcaagcatcgggttacaggtccttgtgactggcaggcatctttgactctaacctggagtgcatagtagtcctatttcacccaatctctgataaatgggaagttatctgcttatttgcttttaccttgcttgctactttttgaaggtaagaaatcagtcttggatatttttgtttctgaccttatatagctcaaagactaccattagtgatgaaaaattttcttttaactcccatatctctatcaggtgaagtaaaaggtaggtgatagtagttactggcagtctagaatggaagtgagttaatgtaatatccagcatttttatcaaataatactcaccaacatcaccttaactacctgaacagcatctaccaatgatacccacaggtgtcctggagatcttgaaatcatctcaggtagaggaagctttcagaaccacagagcttagttacattttctttcaaaaggccaaattctccaaaaacgtcctatgcaaacatcctcgatttcttccataggttttatgataagatctgtagaatgcaaaatattggattagacattaagcagtatccaagtcatgtataatcctatgagcagaatgtccttttgtttccttcatgttggggataaaattttttattagtattgccatatcattttattcattcatgattaagtcaataaaaatttcagctggggccatggttggccaggtgtggtggcttatgcctgtaatctcagcactttgggaggctgaggtgagtggatcacttgaggccaggagttcgagaccagcctggctaacatggtaaaaccctgtctctactaaataatacaaaaattagccaggcgtggtggcgcatgcctttagccccagctactagggaggctgaggcaggagaatcacttgaaccctggagacagacgttgcagtgagctgagatcatgccactgcactccagcctgggcaacagagtgagattgtgtctcgaaaaaaaaaaaaaaattccactggctgggcacagtggctcacgcctgtaattccagcactttgggaggccgaggtgggaagatcacgaggtcaggagattgagaccatcctggctaacacggtgaaaccccgtctctactaaaaatacaaaaaaaaaaaaaaaaaagctgggcatagtggcgtgcgcctgtaatcccagctacttgggagggtgaggcaggagaatcacttgaacccgggaggcagaggttgcagtaagccgagattgcaccactgcactccagcctgggtgacagagcgagactgtcgcaaaaaaaaaaaaaaaaaaaaaaaaattccaaaactcttcccactttgtgacgtgcagttctccaggcactggagctataactgaacaaacagcctgagtcccttccctcacacagtttaaatcctagtggacagaaggcagaccctaaaccaatatttaatgtgtcattttttatcttttttctacatgagcaacccaaatacacccgtttagtgccagaaatctctttgtgttttcacctcgttctggttcctggttctgccagtgacagatgtacagggatgcagcttcttcagggttctgagatgctttcagtgggaaaggggcgcttggatctacaatagataatagaattttctgtgtttctgctcccaaagatgatcctgccaggtactaagctagtaaatgaacacgctgagtttctccttgcaaatttaaataagtcttctgcttgcttttatcatcaaaaagtcctaactctataccaaaatatgagttttctaatttgccataccatagaagaagggtgtgtatgcagtaagtacaaaaggaaaataaatgtcttcctttcagtgaaagagctcttagacccactgctttttattcactgtgctgcttgaagtgaggttagaaaaggaaagctcactgggctaagagtcaggagacccaggtctagtcctgcttgtgccggtcactatatgggtgactttgggaaagtcatttgcctctccagagttcattctcctcaattataaatgaaaatgttacaactgaaaatttatatattatcagctctagtatgtttctagtattgcattcgtttctccacttcgtaactttcatggtttttccagtggtcagatttgggcagaaagcactgattcaagaacacagatttccaagtagagaggtgcagggtaaataaacctccatgtaagcccgcggtgagcgcagactgtgagtgacgaacacggtgtcagtgtaagctggaggtggtgggccaggaggattaaacagggtaaggcagcttaccactgtgcctggcgatgcgcagagtaagtgctcagtaaacggtagctgctgttattagcactgttattatcattgtcagcaaagaacacctagacagccttgagcactggaaggcacctcagagactgtcacaggggttccttgctaggattccaaggaccccagtttcagcagcttcacgaacaccctgaattgcacacagatggcgtgtgtgtgcacatcctatatttcttacacctttcagtagagagggtccctagtttccttggcttcctcagagaaaatgtaacaaatgagcacagtgcctggtccagagggtggcctaccttagggccaggtgtgctgacggaggtaccttgagctgatactcatttccctccctcctcagaactgtcttctcaaccaccttctctctcctacaaagatatgccaagtgctctttagggacagtaccaacacttgacaaattcagctcagcatgaatgtcattgagcccatgccccgtaccaaggcccaggctagcgagtgtaaggagtacaaaaacaagtgggtgtggtcgctgcccttgggactcacattctagtggagaagtcaaacagacccagctcagatacagagcggcgcagggcagagtgctgagtctaggattacagtgcaggctcatggaaggaggtggaatttgtgctgggcctatgtcagaaactcacaagcagggagaagcacgtggggaggtcagcagtccaggcagaggcaggagcatcatgtcagcagatcggtgggaaatctggtgggactggagtctctggagtggagacagggaggaaacagtgaaaggaagatcagagacaagagggtagggcagagctgtggctagcttctgaatactgaacctgagaggtttgagtttatcaggtaaaggaggaggacccttcacagatgctgttcagagtcgtgggatcccgctgggaagtgtggctgagctttgctgtgttgttcatccacttctgttttctgacttggtgttagccacatttttttatggtaaaattcaaaaacataaaatttaccatttcaaccatttttacagtggcattatctaacattcacagtgttatgcaaccatcaccaccatctatctatataactgttttaatcttgcaaaactaaaactctgtatccattaaacaccaactccccagctcccctcccagccccggacaaccaccattctactctctgtttctgtgactctgaccagtctaggtacctcatgtgagtggaaccatgcagcatttttctttgtggctggcttcattcacttaggaaatgtcctcaagcttcatgcatgttgtagcatgtgatgtgattcccttccttttcaaggctgactattccattgtgtagctagaccacagttgggttatccactcatctgctcatgggtgcctggcttacttccaccttttagctattgtgaataatgctgcagtgaacacgtgggtagaaatatttcttcaacaccctgttttagttcttttgggtatatactcagaaacggaattgctggatcatatggtaattctatctttaatttttttgaagaatcacgatttttttttttttttttttttgagacagactctcactctatcaccaggctggagtgcagtggcacgatcttggctcactctgcaagctccgcctcctgggttcaagtgattctcctgcctcagcctcctgagtagctgggattacaggcacccaccaccacgcctggctaatttttgtatttttagtagagaaggggtttcaccatgttggccaggctggtcttgaactcctgacctcaggtgatcacctgcatcagcctcccaaagtgctgggattacaggtgtgagccaccgcacctggcccactatactctttataggagcagctgcaccatttcacattcccaccagcagtgcacaagggcttcattttttccacatctttgtcaatatgtgttatttctttttttttttttaatcataggcatcctaatgggtatgaggtggtttagccagatttgaaagaagaaaagtttaaagggtggcataggataattaacttaatgtttggcataaagccctgcttttttgccatgctgtatttttttctcttgcttttgatctagaattacttacctgtgtgtttctctctatgcagatgaatctataaaatataccatatacaatagtactggcattcagattggagcctacaattatatggagattggtgggacgagttcatcactactagacagcacaaatacgaacttcaaagaagagccagctgctaagtaccaagctatctttggtaagataccctggaaggactcaacgcctagcaaccttgaactttcttacttgtgagaaggacatagtggaatcttaaaatttctctgataattcttcttgaaagttttcttatgttacttctgcaaaatatctttgtaatttccatataattcctttgtcatttatttatttttaatatggagataatcacagtatttaatttatggatttgttgtgaaaattaaatgagttgatatgtataaaaagcttagaacactgcctggcacatagtaagttctataaaaagtgttaaactttcatcatcatcatcatcagtattacttctcagacccagaagaaatagctgtgtcaggccctcatcgaaggagatcctgtaaaagatagaagactgtgccctccacagcacttctgtaataaaatcaagagggctatctcttatagggttctatggtgcagcccataatgctaatcccaaagtacagtctggaaaaagtcatgaggccaaaacgacttgattaagaactcagctttctaattaaccatgggattggcgctttttttttttttttctgtaaaggaaccaatagtaaatgttaggccctgctggctttgaggtctcttggaactactcacctctcttattgtagtgcaaaagcaaccacagacaatatgtacatgaatgagcacggctgtgttccaataaaagtggatttacaaatgctggcaggagtcagatttggcccacaggccatagttggccaacccctggtctaacccatttgaaggacagcttttaaaatacctagaacagaacttgcgaatggtcaggggcacctgtgagaatctaatgaaacccaggatctaccccctacagaaatattgacaaaatttggaaaatatcttgggaagttcttggactgctgacaatctataagatatggatagagagagagccacatcacagagggctgaggaaagaagagaggtgggaaggaagaatgaaatgttttcttccttatattctgtttaatgaggtagtgtggggattaaggaattttttttgttgtggttgttgtacattttcatttgtttccttttattatttttatgaagggcgaagggaaggaaccagtagaaggagagaggttatggctattggagaagaggcaatgtcggtcggcagtggggtggagtaaaggaggggttagggtccaaaaacagaccttgaagagtatagttacctcgtcgcttgaaagacaaggaaggctttgtaactgaatgggttcacgcctgctggacaattccttgattaagtaagaggaaagtgaactgttgggccggggtggtggtcaggagttgagcggctttaactctggccagatgtaagcggagaatgtctaaaaggaacaaaaatggtggttttccctttacacccaggaaggtctaataccaacaggatcactggctaagattgactagaacacccaacctcgtagccacacaggggttttgttcacagagccatcagctgtggctcagggatgtgtctactaggaggaaggaatgccttattcttttttgttttgtttttgagacaacatcctgctctgtggcccaggctgaagtacaggggcacagtcatggctcactgcagcctcgaactcctgagttcaagtgatcctcctgtctcagcctcctcagtaactgggactacaggcatgtgccaccatacccagctaattaaaaaaaattttttttttggtagagacaggttcttgctgtgttgcccaggactggtctagaactcccgggttcaagtgatcctcctgccttggcctcccaaagtgttgggattataggcatgagccaccacgccaggccgggaatgccctattctaattcacataaagactccatgtgggctagcaggcatgtgaaatgtctgccagtgcatcaacagctatataactaagaagttatctttttcactgtcttctggtactcttcatttcacttgggttttttagcaattcaggaagctggaatgtttgaatgggttttagcttgataccttcttctttttcccatttggcagataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaactaaccctggatgggctacggcagctgaagtggacgcctcacttagtggataaccccagaaagttggctgcctcagagcattcagaattctgtcctcactgataggggttctgtgtctgcagaaattttgtttcctgtacttcatagctggagaatggggaaagaaatctgcagcaaaggggtctcactctgttgccaggctggtctcaaacttctggactcaagtgatcctcccgcctcggccttccaaagtgctgggatatcaggcactgagccactgcgcccagccaacaatccgctctgaggaaagcgtaagcaggaagacctcttaatggcatagcaccaataaaaaaatgactcctagttgtgtttggaaagggagagaagagatgtctgaggaaggtcatgttctttcagcttatggcatttcctagagttttgttgaagcaagaagaaaaactcagagaatataaaatcaacttttaaaattgtgtgctctcttcttcacgtaggctcctgttaaaaacaaagtgcagtcagattctaagccctgttcagagacttcgtggatcacagctgcagctcaccgccacatcacaggatccgttaacgttaatacccaatactctgtcagccactgtaggctctaagaaccacgtgcagtcttcagcccattaaattatcgattattttttaatgaattgaatttatattgagtcttcaaattaactgaatggatttaaaggggtaccaaggaggggggaaacatcagaatttcccaggcagttgttgcaaggaattggtactaaccgtgactacaacaaaaattcttgattgacttttaaagttatttcctggcattctggtaccttcacccagcctgagtgccctggagagggaacaggaaatgctgatctctacccctgggtgagaccagaacctcagggctgatactgttgagtggcttcctcggtttactctgtgtactgtgaaagtattttcatattttttctgtgtgccagagtgaaaaaggacagcttctgagtgtggtaattgtgcctctagcacccagcctttcaaagcccacctgaaacctgggggtggatgaaagaactagaatagaagactgaagctgggtaggccgctcagtgtccactggcattttgctaaaccgacaaggaaggctgtgtgcttagctctccccagagggagggcgagaagggtgtggtgatggtcaatctggctgtcggaacagattctggtgtcttgggctgataacagtgttgttgattctgattgtgaatcccctcaactctagcagacacatacacacccctgaaatggggctgcagagcaggctgtctcagccttgccactgtcggcatctcggcctgggtaattctgttgtggggactgtcctgttccttgtaggatgtttagtagcatccctgcccccacctactagatgccaggggcactgttctccccagccccccgccccagttgtgacaatagtctctaaacattgtcaaatggtccaaggaaaggggaaaattgccccggttgagaagagcactgctgtaaagtaatgagcctcggctctcctgtctgcacctgtccggttactacttggccaccacgcagccttggctcctacagcccaaaagggagaatggagggaggctccaggctttgctggaggggcctgggtgagttctgtttgctccttgtaccaccatccaaatggtgttatcaaatctcttagattccaaagaggttgaataattaatgttcaaaggcaagagggcaaggcattttttaacactttttaaaataaaaatttataccacaactttaggctattgatgtgatgtgtcactgggacagatgcggattctccatggtgcctctgccactgaggccgcatttcctgagcataatccccttttaccctcccgctgccaagcaggagacgggatgctgatggtaagaacacctccctgccagtgcattttggcgctcaggatgagaggcctgcagcactgctgtccccgcgcctggctctggggccttcccttcacccccactctctcagcaccatggtgagaagaaccaagtttgcctgtgaggagttaggtacaaggcccaagctccacaagaacactgctgttaatgggcagagccaatgacgacacagaccagcaaagcagaaccgagactgtccgcacttggttcggaaacaaatactcacaccctaggtta

SEQ ID NO: 13395 - DNA, 1227 bp, Homo sapiens
ggaatgagagtggtgtcaggtactttgtttatccactttctggtcttgatattttgattgtttgggtgggtgtttagtagtatatttggttttttggtagagtcaaaatggagtggtggtactgaagatagaatagtgcacggttccactcatcttcccctgagatctgtgtgcatttatgaagtttacaaaatggtagttgtgatattggaattttcacttgtagaaaaaaaatgctgtgttttccaaatattttgagaggtcatcatagttaaggaaaatctgtctgttcccatatctctttttaataccaagtttatcagttatcagcattgaatagttgttcctccattttttattcatttatccaacatgtcttgagtgactaatattctgcactaatatgtgcagaagatttttttaaacacatctaaatattttttgctttgccacaattaaaaacagtgactattagctgtcctgtctctttcttacctttgacctcttacctctctccagcaaagatctcttctttacaaaaacttgtacctgaccctgctattctcactttattttattttccctattatacccataagaaaactgaggcttagagagtttaagttacttaaccaataccacaagtcagaggcagaagcaaaattcaaacacagataatcttgcatctgagtaatgttcttacctagcactctagactgccttcagcagtggacaagagagatgaggcagtgccaaaaccctccaggctatactgttgttcattctgagaacctgggactcttgacctaattttccctcttgccagcatttttgctctgcttcctgtcactgccaacagagtatggatgtggtcagtaaggtgtggatagtacaggtcaccctgatttccttccttgatctgtgcagaaatgcatgctgtactttctccacttaaagatgagtggatagggacagagaatgacaaaaaaaccaaaacagatcaaaaaccccaccatactggacaagtgtctgagagtatacaaatattctaaaagaggcattttgaatttaaattttcttcacaattaatgcaactctgcaaaagttaaagaggaatagcctgaggagaaaaaatatggtcataatataacccccagcctttcttacttttgatgtacttaacccttattgtgctttgaggtttgaatttttttttttttttttttt

SEQ ID NO: 13396 - DNA, 1241 bp, Homo sapiens
ggaatgagagtggtgtcaggtactttgtttatccactttctggtcttgatattttgattgtttgggtgggtgtttagtagtatatttggttttttggtagagtcaaaatggagtggtggtactgaagatagaatagtgcacggttccactcatcttcccctgagatctgtgtgcatttatgaagtttacaaaatggtagtcgtgatattggaattttcacttgtagaaaaaaaatgctgtgttttccaaatattttgagaggtcatcatagttaaggaaaatctgtctgttcccatatctctttttaataccaagtttatcagttatcagcattgaatagttgttcctccattttttattcatttatccaacatgtcttgagtgactaatattctgcactaatatgtgcagaagatttttttaaacacatctaaatattttttgctttgccacaattaaaaacagtgactattagctgtcctgtctctttcttacctttgacctcttacctctctccagcaaagatctcttctttacaaaaacttgtacctgaccctgctattctcactttattttattttccctattatacccataagaaaactgaggcttagagagtttaagttacttaaccaataccacaagtcagaggcagaagcaaaattcaaacacagataatcttgcatctgagtaatgttcttacctagcactctagactgccttcagcagtggacaagagagatgaggcagtgccaaaaccctccaggctatactgttgttcattctgagaacctgggactcttgacctaattttccctcttgccagcatttttgctctgcttcctgtcactgccaacagagtatggatgtggtcagtaaggtgtggatagtacaggtcaccctgatttccttccttgatctgtgcagaaatgcatgctgtactttctccacttaaagatgagtggatagggacagagaatgacaaaaaaaccaaaacagatcaaaaaccccaccatactggacaagtgtctgagagtatacaaatattctaaaagaggcattttgaatttaaattttcttcacaattaatgcaactctgcaaaagttaaagaggaatagcctgaggagaaaaaatatggtcataatataacccccagcctttcttacttttgatgtacttaacccttattgtgctttgaggtttgaattttttttttttttttttttttgagatggagtct

SEQ ID NO: 13397 - DNA, 1241 bp, Homo sapiens
ggaatgagagtggtgtcaggtactttgtttatccactttctggtcttgatattttgattgtttgggtgggtgtttagtagtatatttggttttttggtagagtcaaaatggagtggtggtactgaagatagaatagtgcacggttccactcatcttcccctgagatctgtgtgcatttatgaagtttacaaaatggtagttgtgatattggaattttcacttgtagaaaaaaaatgctgtgttttccaaatattttgagaggtcatcatagttaaggaaaatctgtctgttcccatatctctttttaataccaagtttatcagttatcagcattgaatagttgttcctccattttttattcatttatccaacatgtcttgagtgactaatattctgcactaatatgtgcagaagatttttttaaacacatctaaatattttttgctttgccacaattaaaaacagtgactattagctgtcctgtctctttcttacctttgacctcttacctctctccagcaaagatctcttctttacaaaaacttgtacctgaccctgctattctcactttattttattttccctattatacccataagaaaactgaggcttagagagtttaagttacttaaccaataccacaagtcagaggcagaagcaaaattcaaacacagataatcttgcatctgagtaatgttcttacctagcactctagactgccttcagcagtggacaagagagatgaggcagtgccaaaaccctccaggctatactgttgttcattctgagaacctgggactcttgacctaattttccctcttgccagcatttttgctctgcttcctgtcactgccaacagagtatggatgtggtcagtaaggtgtggatagtacaggtcaccctgatttccttccttgatctgtgcagaaatgcatgctgtactttctccacttaaagatgagtggatagggacagagaatgacaaaaaaaccaaaacagatcaaaaaccccaccatactggacaagtgtctgagagtatacaaatattctaaaagaggcattttgaatttaaattttcttcacaattaatgcaactctgcaaaagttaaagaggaatagcctgaggagaaaaaatatggtcataatataacccccagcctttcttacttttgatgtacttaacccttattgtgctttgaggtttgaattttttttttttttttttttttgagatggagtct

SEQ ID NO: 13398 - DNA, 285 bp, Homo sapiens
ggaaaaattaaaaagtaatatgcagtgctccccttcaagaaagttatggcctagagagaaaccaattcttagaacataatatgaagtttgtaaatggacgttaacatggcgaaaacagtgcacagataaaagtcaatgcaaaagaaatgtctcatagcattgttctattgtaatggagttgattaatttattcagacttttggcaagtgttctttgcacacgtacattctgccaaacattgtttcaggcattgaagatgcaacagtgaacaaaacagattgaaaa

SEQ ID NO: 13399 - DNA, 483 bp, Homo sapiens
gtgctgagcagaaaagagactttcttttacaccttccatcttttgagcttttggtcctactctttcaatttttgctaaatagtaaatggggatattgttgtttttcagatgaacacgtgagtacatttgcattactgagcttgctgtctctagttctaaagagattctttacaatttccgtatcagcaaaggaattgccttgatttcctttgatgatgtttccctgctgatattctagacctagcacagaagcaattggtaccctcgtgaaaatgctcttgcccagtaattctgctttatttgtacatattcagctttaattacaggggtaagtgggggaaggagaagaaagccaaaaatacccactgcccccaagtggaagaacaagaagaagcttgactccctcaacttgcaggagtacaattatattgtaactgaggttgttttcctagatgtcagccagaaagataaacactcaaagtt

SEQ ID NO: 13400 - DNA, 278 bp, Homo sapiens
ggaaaaattaaaaagtaatatgcagtgctccccttcaagaaagttatggcctagagagaaaccaattcttagaacataatatgaagtttgtaaatggacgttaacatggcgaaaacagtgcacagataaaagtcaatgcaaaagaaatgtctcatagcattgttctattgtaatggagttgattaatttattcagacttttggcaagtgttctttgcacacgtacattctgccaaacattgtttcaggcattgaagatgcaacagtgaacaaaacaga

SEQ ID NO: 13401 - DNA, 278 bp, Homo sapiens; identical to SEQ ID NO: 13400

SEQ ID NO: 13402 - DNA, 484 bp, Homo sapiens
gtgctgagcagaaaagagactttcttttacaccttccatcttttgagcttttggtcctactctttcaatttttgctaaatagtaaatggggatattgttgtttttcagatgaacacgtgagtacatttgcattattgagcttgctgtctctagttctaaagagattctttacaatttccgtatcagcaaaggaattgccttgatttcctttgatgatgtttccctgctgatattctagacctagcacagaagcaattggtaccctcgtgaaaatggctcttgcccagtaattctgctttatttgtacatattcagctttaattacaggggtaagtgggggaaggagaagaaagccaaaaatacccactgcccccaagtggaagaacaagaagaagcttgactccctcaacttgcaggagtacaattatattgtaactgaggttgttttcctagatgtcagccagaaagataaacactcaaagtt

SEQ ID NO: 13403 - DNA, 2892 bp, Homo sapiens
acaggggtgagccaccgccccaggcctctttcggcactgccctcaaccacatgggcctcactgttcttccggcgtacccagactttccccatctcagcgccttcccaccggtcctgtgtttccatggcctttccccgggtaggggcctttcttttcctagcttcgctcagttccctgctacattgtcgcctcctcgcagaagccgtctctggccgttccgtatcgctagcgccctctatcattcgctagcagctcacccggctctgtttttcttcattgcacttctcgttatgtgccgttctcttataaatgtttttgtctttatccctcccatagaagacacctccatgaaaggccagggctttccgaggttcttttcctctgtggttcctagaagagggcctggcacatagccggccttggctagctttttgcgtaaatgtgaagggatccaccttcctccgttataagaggtagcagtacctcctgttaccagcagagggcaccaccgtacagcacttgggggccgcaggggatcctgctgggatgggaggtatttaaaaagcccacaggcctctcctcccataatgtgggcgctcccacagctgggaccggaagcaggagggccccctgcgctaatctgccctggcagcagcgagctggcacgccctgggtgcatcatccggtgtgctctggtgcccaaggtcggaataccctcactggtggcttggacacacccctgagcagctgatgcttctggacagatcacaccctgtcccgggctctcaaaatgagggcaatgacatgagctgcactgctcgctcacgcgtttgctgtgagtttgggacaggagtgcatgggaaatgttttatgaatgtaaacatgggacaaatataatttatgcacgcctttattggtagtgcagcagattgacaacaaacgaggggagaagataaggtatttaaaggaaattgcaaggctaaatgaaggtgggaattaagacagtgaaggagaacgaagaagttaaaaataacaactacctttcaccaagagcttattaggagccaaggcagaggaaagtgatctccaaacattgtctaattatagccaacacttacatggtgctgacctcatgccaggaactctttaagtgctttatgcataaaaactcactggatcctcacaacaactcagggaggtaggtcatatcgctgtcccgttctacacaaggaaactgaggcccggacagcttaagtgactggcccaaggccacatagatagacagggctgggcaatctgcctcctggaatgtgctcttaaagccccacagtcacagccacaccaaaagggagatattattattatcattccatttcccaaacaagcaactgaggcttagcagatgtacaaagcccgcctaaagccacactgggaatatgtgtatttgagcccagcttaaccacccaccaaactaggcctgcaggagctaggaggggcttcaggaatgtgcacaggttctctcggagggcagcagcagacatacccactcttcctctgagcggggaggggaaggtgagagcacagaggctgggcagggctgatggggttgaggaagaggctgcttggtggcctcaactccatggaccgcagatggccaggcatcttctggccaggaagtgagaggtgtgttgataggcacagtggctgtccacagggattccagccagagctgtggggcccccacaaatctccatagggagactagggactgaggggtgggcttacagtgggaggtgggagcagccccatccctaccacaagtgccccttagcccagccctgacttcagccgttacataagctgctgcatacccaggcctggaaatagctgaggctgtaccggctgggctgggagacgtgatgaatggtccccaggagcatcagctgaccgccctgtgctcctgaagtgacctgagggcctgccagcagctcgggttacccagctctccctgggaggcagccctgcctggtctgctgaggatggctctgatgtgattctgtgtctggacatttatggttcgagtgcccgcaggatggtccctctcccaagcctgagcagctaaggcagctcccagccacgctgtgcccactggcagcctctggatgctgggagccagggccttgcccagagcaagcacttggatctctgcagacagtcagcactgggagggctgagagctctgctgctctgagtcctgtgctaagggcccgcaaggaaagaggaagaggagcctgagaaactcggggtgcacgtgggggctgcaggtgtcattccagggctgcactccacccacatccccatgcctcctgtttcacggcccactctgttactgaactggtggccctgggcacaggggggcacccacacactctgatgcccactgcagagggcagagccacacacccctccagggactaggcacatacacccttacttctgagagtaacgtggctaggctcaggagtgtaggagggcgttctcccagcatatggtgatcatatgttaagaattattattatgttggtcaggtgcggtggctcacacctgtaattctagcacttttagaggctgaggtgggaggattgcttgagtccaggagtttgagaccagcctgggcaacatgatgaaatcctgtctctacaaaaaatacaaaaattagccgggcgtggtggcatgtgcctttagtcccagctactcgggagtttgagatgggaggatcgcttgagcccaggaggttgaggctgcagtgagccaagattgtgccactacactccagtctgggtgacaaagtgagaccctgtctccaaaaaaaaaaaaaaaaaaaaaaaaaaa

SEQ ID NO: 13404 - DNA, 2897 bp, Homo sapiens
acaggggtgagccaccgccccaggcctctttcggcactgccctcaaccacatgggcctcactgttcttccggcgtacccagactttccccatctcagcgccttcccaccggtcctgtgtttccatggcctttccccgggtaggggccttttttttcctagcttcgctcagttccctgctacattgtcgcctcctcgcagaagccgtctctggccgttccgtatcgctagcgccctctatcattcgctagcagctcacccggctctgtttttcttcattgcacttctcgttatgtgccgttctcttataaatgtttttgtctttatccctcccatagaagacacctccatgaaaggccagggctttccgaggttcttttcctctgtggttcctagaagagggcctggcacatagccggccttggctagctttttgcgtaaatgtgaagggatccaccttcctcccttataagaggtagcagtacctcctgttaccagcagagggcaccaccgtacagcacttgggggccgcaggggatcctgctgggatgggaggtatttaaaaagcccacaggcctctcctcccataatgtgggcgctcccacagctgggaccggaagcaggagggccccctgcgctaatctgccctggcagcagcgagctggcacgccctgggtgcatcatccggtgtgctctggtgcccaaggtcggaataccctcactggtggcttggacacacccctgagcagctgatgcttctggacagatcacaccctgtcccgggctctcaaaatgagggcaatgacatgagctgcactgctcgctcacgcgtttgctgtgaggttgggacaggagtgcatgggaaatgttttatgaatgtaaacatgggacaaatataatttatgcacgcctttattggtagtgcagcagattgacaacaaacgaggggagaagataaggtatttaaaggaaattgcaaggctaaatgaaggtgggaattaagacagtgaaggagaacgaagaagttaaaaataacaactacctttcaccaagagcttattaggagccaaggcagaggaaagtgatctccaaacattgtctaattatagccaacacttacatggtgctgacctcatgccaggaactctttaagtgctttatgcataaaaactcactggatcctcacaacaactcagggaggtaggtcatatcgctgtcccgttctacacaaggaaactgaggcccggacagcttaagtgactggcccaaggccacatagatagacagggctgggcaatctgcctcctggaatgtgctcttaaagccccacagtcacagccacaccaaaagggagatattgttattatcattccatttcccaaacaagcaactgaggcttagcagatgtacaaagcccgcctaaagccacactgggaatatgtgtatttgagcccagcttaaccacccaccaaactaggcctgcaggagctaggaggggcttcaggaatgtgcacaggttctctcggagggcagcagcagacatacccactcttcctctgagcggggaggggaaggtgagagcacagaggctgggcagggctgatggggttgaggaagaggctgcttggtggcctcaactccatggaccgcagatggccaggcatcttctggccaggaagtgagaggtgtgttgataggcacagtggctgtccacagggattccagccagagctgtgggccccccacaaatctccatagggagactagggactgaggggtgggccttacagtgggaggtgggagcagccccatccctaccacaagtgccccttagcccagccctgacttccagcccgttacataagctgctgcatacccaggcctggaaatagctgaggctgtaccggctgggctgggagacgtgatgaatggtccccaggagcatcagctgaccgccctgtgctcctgaagtgacctgagggcctgccagcagctcgggttacccagctctccctgggaggcagccctgcctggtctgctgaggatggctctgatgtgattctgtgtctggacatttatggttcgagtgcccgcaggatggtccctctcccaagcctgagcagctaaggcagctcccagccacgctgtgcccactggcagcctctggatgctgggagccagggccttgcccagagcaagcacttggatctctgcagacagtcagcactgggagggctgagagctctgctgctctgagtcctgtgctaagggcccgcaaggaaagaggaagaggagcctgagaaactcggggtgcacgtgggggctgcaggtgtcattccagggctgcactccacccacatccccatgcctcctgtttcacggcccactctgttactgaactggtggccctgggcacaggggggcacccacacactctgatgcccactgcagagggcagagccacacacccctccagggactaggcacatacacccttacttctgagagtaacgtggctaggctcaggagtgtaggagggcgttctcccagcatatggtgatcatatgttaagaattattattatgttggtcaggtgcggtggctcacacctgtaattctagcacttttagaggctgaggtgggaggattgcttgagtccaggagtttgagaccagcctgggcaacatgatgaaatcctgtctctacaaaaaatacaaaaattagccgggcgtggtggcatgtgcctttagtcccagctactcgggagtttgagatgggaggatcgcttgagcccaggaggttgaggctgcagtgagccaagattgtgccactacactccagtctgggtgacaaagtgagaccctgtctccaaaaaaaaaaaaaaaaaaaaaaagaagag

SEQ ID NO: 13405 - DNA, 32100 bp, Homo sapiens
tcagcccaaactcatgttctcaactttattccccatcccagtggtggctcttctgtacagtggagaaagaagggggaccccaccagggctatggagagacagtagaggcaggactgaaccgtcagcaaagattaaaaggatgacctgaggctggcaaccacaaaaccaagaagccagcgggggctgccccttccaagtctcaccaatgacccagagcaggttccagagcccaaaggcccaaaagtgcaattcccaaaagccaaggtctgggagccatcaaggagctcccagagatccagcgacgctcagagggcaagggtgtctttgatgagcctgcgcatggtggtggtgactgaggtgcccagggcatcagtgatctggaaggagatcttgtacaggtagggctgcacgtcccgcaagcctgtgtcaaacacgttatccacctccgactgtgtgggcatcttgggcaagtactcatgccgattcatcacctccacgatgttgatgatcttctcgcagagtttctcacccaccttctcccggcagatctgccgctcctgctccgtggccagggctaccacatgcaccttgaccgtccacacttcccatgggatgcactcgtctgagaatggccagcgagacttcttcttctggtagaactccaaggacatctgccccagcccatcgccaccagagttgcgcagtgcatcctgggaagaagggaacgaatgagcaagccaaggcctctgagttcccacctgtgagggcctgcttcccacaccccagggaattatgctctcttagctctagtcatcatccaagcatggcaaggaaacaagactgggagagggtaaacgatttgggcttagtgacacagcaaactgccagcctgaaattgtgtagttcaagcaaaccaacaaaatctgtctccaagcccaactcctccagcttggtgaagaactgatattacaggaataactactggtctgcaggcacgtattctgtgctaggaacttaacacacacaatcccactggctcctcccaacaaccccatcagctttcaccaaggcacgatgaggcttagagaagtaaggtaacttgcgagagtcacatgcctatggatggctggaccagggtttgaatctggattgtctgatttctaaatccttgcttttcacctttgcattgcatcaagggcctcctccttccacaccacccctttagcccatatccttcaaaatgttctaatcacctcgtcaacatttccctcttcccctgtaaactctatttgtcttctccactgccaattaaacataattcttttgatattttttaaagaaactgggtcttactctgtcacccaggctggagggcagtggagcaatcatggctcactgcagcctcggactcctgggctcaagcgatcctcccacattagcctcctgagtagctgatactacaggcacacttggctaagttttaattttttttattttgttaagagacggggtattgttacgttatccaggctggtctcgaattcctgggctcaagcaatactcctgcttcagcctcccaaagtgctgggattacggtcacaagccactgcacccagttcacagtctcttttatgagctaaggaagagggaactgtagagcccagtggtccttgctcaaaaagagggaaaccaagcaacagaatggggaagggaagttgaaggacagaccagacctggcacttctccctcttctcccctgagaagcaaacaggaccatccagtccaatgattctgcccttgccaccccatgggtgtgagtggccccatactcctcttcctagggcagccaggaccctgaagttcctttccatctgagttaataccaacccagagggtaaggatgcctgaaatcctgaaccacactcatcagggaagaggctttccttcactgacaaaccaaggtcaagtaaccttgaatggctaatgcatctgtaatgtttactgtgtgccaggctctgttccaaacactgggcatatttgacttattcagtccttgcagtgcacacaccctttgaggtaagcaagattattattgcaattttgagtggagccgctagcccaaggtcacacacttgctgggtggcagaccccagctccaaagcccatgctcttcaccactctgctccacctgcctctcatggacacctggaggacacagggctgagtgctgctgctgctcttaagggtgactaggaaaccacttatgaacttgccctttctgggtttggcgggacaatgagagacagctttcacctgacactgggcaaccccctgcaatgagcacacagtacccagcacagtgaagggctctgcaaatatttatggaatgaaagtcagacacacagctcccccgtgttctaaccccagagcagatgccttcaggctcatgccagtaattcaagaccagcctttagttcaagaccagcctgggcaacacagtgacaccccatctctacaaaaaaaattatttttttttggagacagggttttgctctgtcacccatgctggagtacagtagcatgatcatggctcactgcagtctcgaattcctaggctcaagcaatcctcccacctcagctgctcaagcgtctggaactagaggcatgtgccaccacaccccactaatttttgtattttctgtagagacggagtttcgccatgcttccagggctggtcttgaactcctgggctcaagcaatccggccatctcagcctcccaaagtgctgagacaacaggcatgagccaccaggcctggcaaaataaatcttcaaaaattagccgggcatggtggtggtggtgtacacctgtggtcccagctgcttggaaggctgcagtggaaggactgctcgagcccaggagttcaagactggggtgacatagtgagactgtgtagtgagaatgggagaaaatatcccctgagaattcataacggcaagctggcctccatgatgtgattttattcaaaattcaccctatctaggcagtctgaaaaactacacgctatttagattcaagtggtctgaggcccatagtacttcctggtagtacgtggaagaaagaagagcaaatcatctgtagaggaacccaaattgaactcaggctacagggaattctcacagaccaaattttaagaaatataatctgcatagacaaaaatccaaaataagcccaagagaaaaataacagtcaacttaaaattgtatactcacagaaatggctttaaagatcaagggctaaataaaaaatatatgttacgtatgaattcgtgcatactttactaacagttaagtattcactaataggagaggaacagagtgtataacttagaggttaagaggatgaagaaatagaattatacaaaataatccaaaaggaattgagaaaggaaataaaaaggacaatataggttgagcattcctaatccaaaaatccacaatccaaaatgctccaaaatctgaaaccttctgagcactgacataatgctcaaaggaaatgctcattgcagcatttcagattttttatttttggattaggaatgctcaacacgtgagtaccatgcaaatatttcaaaatcctaaaaactctgaaatccaaaacactctggtcccaagacaagtgatactgaatctctggtaaagtgggataaatagaaagaagaaaataagatggtgaaaataaatccaaatatatctgtgattacaataaatgtaaatggactaaataatccaatttaaaaataaagatttccagactggacaagagaaaaagaaaaggggattgcagaaggatacacaaggtgaagggagtgtttactcccttttgttgctttaataagaggagaaagactgcagcttagactgcaataaaagagccaagaagagttcatagatacaggaagaagtagtaagtaatggaaccagaacccagggtagatgagaagcacaggataaagatccagaggtacagtgattagccttggcatggaggaaattaccttgctagagctggagaaacgaggtaaaccaagagaaagtttataggcatgaagggtcatcctgatgttctcagtcaggccctctgtttcggtacagtatgctcagggggcatggtggcatatgatggtagatgtgcttgaggaaggtggtaaggatttgtaaaaagccactgtggagaatgggagtggtgtccagggacatagaaaagcagaaagggattgtcagagtggcactggggcccaggcaggattacagaacataaatttgaggtcataacaagcctcttttataataccatttcctcaggaaatgctcagcagtccaggctgggagcagaagaggggccgtttggaggttgaaggtgtaggggtggggccctggtgaagggacaaatgagccaggatggtgagggaagcagagggaggggaggttaggcaatgaagagaacttggatgggatatgcctggtgactgaggatgggggctaattagagggattgctctgggcccaagaagcccaaaggccagagtcagcgttagggtcttgctgtggtcagcagcctgtagtctgtgtttagcagtccgtggggtggtgcggagctgtggtgtacttggagaaaaccctcccaggcttttcttgctcactttctactccagaggcaattacatgatttttagaagcaagccttctttggttcttttaatctacacattgacctcatcctccccctaccccatccattccccagtgcctccttggaaataggccctgtgccctcagccttgatgattaatatatcagtttctatctatctgggaaggccagtggccaaatgggattgctctcctggtcattttccttttgttgtggacctcacagcttttgcctatctggctggtcccctcctgcgatgctacagtccagaaccttacacaacacatctctgggactactggtggtgtaacctccctgcctcctggtcaccctccttccagtccgcaaggcaccctgcaacataactgtattctaagaaagcctccttcattttgtctgtcatctgccttcttcagaatccacaggctccctatggccaagccaaaagcttggctttctaaactaagaggggatttaagaaatgattcagttggactcccttgtttcacaggtgaggaatcccaggctcagagaagatgtgtgacttgcccaggacagagccaaaactggtagtgaggcctctacgtgatgagaacttactatccatcctaactctcctgcacatcacaatacatgcagagactgcatgtacatgcttaacctctctgacctttgggttcctcatctgtaacatgggaatgataatctttaatttcggaaaaatgttgtgaggatagaatgaaactgtcgtttatcaattgctaaaggctgtagagaacattgactcctaagaacttggcacagattatttactcgatcttcacagcaaccgcatgagagtagtattattcactccatagtagagacaaggaactgaggcatagagggattaagtaatttgcccaaggtcacctggctcacccccgtcctgacagctcctcttttgtcctggcttcccccatccacccccttctcacacacacacacaccacacaaccaagtgcctcatgtagttttcctcctgtctggatctccagagtctgccgctgtcacctgctacacccacttctcctaggggagtttgcatggtctgccctctggccacagatgatcgcaccagggctgggcattgaaccaagggaaagcaagaaataaactggctgagccatgcaagtcctttctcatgagcatttgaactaagaagttacaaaaaccgagttacttaggtggtagcgagcaatggagactagctggaagctaccctgggccagggtgagccaggagaggagagtggagcagaggcccagggaaaggagagaccagagacccctggtgttcaccccaggtgtgctgggaatgtgtccatgcacacacaccctctggcctcgcccactctaacagaatccccaacatataatcagcccagcgtcttctcagatcccatgggatctgactgtattttccactgctgggttctctgagattcccatctatcttcctaggaaatcctcttttcagttccactggtttgagtgtgtttgtccttatagcctgtgagccctggctagaacaccagctcaagtaattcgaccagctcagggcctgactcctctgggaagccttctccctacctctctgtattcgtctcgtcttccccagacagatcccaaaccctatcacagcggcggtcacttccctttccttctcagcatccagcacgtacttgtggattggccacatcttctaactttggggtgccatttccaattttgctctttgaaattatactatcattatggttactacttagtgttctagcaaatccatgtatccgtccatcatctatttattcttggaacatgtatttagtgtctgtgtcaggcactgggctaggccctgggaatgatgaggataaagttcttagttcttgccccataggagttcacagtccaggagggaaatccagcttcctcttgccaaactggtcacaccaacacagcctttgctttcatgatcccagctacacataaacacacactccagacatgactattagccctgtcacgttgtcacacacacccaaaaacaggctctatcttgttttctcctccccattccccttcttcacaccgagtgccacccctgtttcctgcctggcctctcactgtgctcagctctagaagatgccgtgaagtccttgctccaccctctactctccctccttttttgatcctcattctatggtacgggaattgacactatagtctaaatgtgtatgtttgtgtgtgtgcatgcatgtgtgtgtgtgtgtgtgcgcgcgcgcgcgcgtgggcctttatgctattttaagaccccagcactttgcaaaaacctgatggagaatcctgccaaagcccaagggtgggggaggggaggctgggcaatctgagcctggggcagaccgggcgtctggggagccaggttagcagccgccagctgcagagcctgggctcaaactgccgccatcgactgctggtttcctggcccgcgccagcccagcctgacccgttctgtccacctcctctttgccatgcccaagtcctcattcctctccatgggttgcttgggagtttgcacaccaggcatcatgtaaaattgttgtgtttctggaaacacatacacatgcagagaagccttgaaattcttcttggaacaggtccagggatttatttatgaaattcccagggggtgagagagacagaagtctggactttgcagactgagtgctgtgccgtcatcttatcaacataaccaccagctctagtgtgcacttactaaatgcccactgcgtgcccgggccaggctggagggggcttgtggggagcacaggtgctcagtactgcaggcagcagggatgccttctctccccagaggaaaaaaaccagacatggtattgacatgttttgggcatggtccccaactctgacctccctgctctctctcccagcagccctatctcctcactttcttgctctccttctctctcagtctgcaggctctctctctcttacccaccttcactttggagtccatgctgtcctgtggatgggtgtgtgggtcttccaaagaagggcttcgagggtaacatctacagcagggagaaactgtagtgtgctcaatgcgctactccaattctttgcagtatggcatggagaagaaatggggtttatgtgcaggcatggcagggtctgcagaggctagagaaagctggggtgtccaagcctcttaagatagtttccactgggcgcggtggctcacacctataatcccagcactttgggaagctgaggcgggcagatcacctgaggttgggagtttgagaccagcctgaccaacatggagaaaccctgtctctactataaatacaaaattagccaggcatagtggcgcatgcctgtaatcccagctactcgggagattgaggcaagagaatcgcttgaacctgggaggcagaagttgcagtgagccgagatcacaccattgcactccagcctgggcaacaagagtgaaactcggtctcaaaaaaaaaaaaaaaaaaaagatagtttccttgtcctgcccaaggactttaggtggacgcttcactgggaactagatggtccccaatctgatcagactgatgatgttggggatagaacctttgctctgcttccaggaaccaaatgtgtagagctttctgcagcaagacaggtcaacaggtctctgccccttatctagcccaccatctccaagagaacccggcaggacttgaggcttctgttgcctccctttaattcagtaggggtgggtctgaatgtgtctttagtttcccatgtacaccctgcctttgaggggaagccatatgatcaatatctgtggaatgaccgattttatgcaaatgtaattttagaggtaagctcccagtggaaaatatggactagtctatcagagatgagatagaaagacatagaaggccactgcacttaccacaggaagtgggggacttttaaaaatcaaaggtggctgggcgcagtggctcacacctgtaatcccaacattttgggaggccgaggcgggcagatcacttgaggtcaggagttcgagaccagcctggccaacatggtgaaaccccgtcggtactaaaaatagaaaaattagccgggcatggtgttgggcacttgtaatcccagctacttgggaggctgaggcaggagaatcacttgaacctcaggaggcagaggttgcaatgagccaagatcgcgccactgcactccagcctgggtgacagaacaagactccatctcaaaaaaaaaaaaaaatcaaaggccaccaccatctagaaaataatcaagtcaggggaaaggtaatgaaatatactaagtcactggagcctgagcaacatagtgagaccctgactccaccaaaaaaacgtttaaaaattaaccgggcatggtgctgtgttcctgtagtcccagctactcgggaggctgaggaaggaggatcacttgagccaaggaatttgaggctgcagtgagctgtgatcacgacactgcattccagcctgggtgacagagcgggattctctcagaaaaaaaaaaaaaaaaaaaaaaaaaagccagaaaagaaaagaaaaaaacaaacactggaacaacaataggaagagtcctttagggatgacagaactttccctactctactctaagcagcctaggctcccggctctgaagtttaggctcccacttggtttagaaataaaaaacccaaaacatcccaggggtctcacagacctcaggatttctctcccttccttgggaagccccagcctggttacacagaatgagttggggtggggagatatgccttccatgccttccagcagcctctcccaggtaaggcaatcaggtgtgggcaggctcaccagcctgagaagcctgttgtgagtaggcgggcccattcctggctgagaggagggcagcgtctgcctgccagggcctgtgttcacgcccatgcatgcgtgcatgtgtgtgtgcatgtgtgagtgtctgtgttgggagagggttggcacggcactgaggacacagaaatgtatcccactcatatctctaaagctagcctacgctacatgacccttctcccaggcttatgggaggataggaaggctcagatctatttcctggcatcttagtagcaaccatgggctttgggttcagacacatctgagttcaaattccagctctattacttgctagctgcgtgatttgggacacattgcttaacctctctgacctttgggttcctcatctgtaacatgggaataataatctttaatcttggaaaaatgttgtgaggatagaatgaaactgtcttttatcaattgataaaggctgtagagatgagaattatgacttccaaggggtccataattcaggcactgacgtcagactgccaggtttgaacctcaccatacctctgtcacctcacctgtaaaacatggataacaatggtacctacctcattgtcatgaggatcaaataagtcaatacatacacagcacatttaatagtatctggctattgtaagtgctcaaaatgtgtcagcttctagcacagagctggtgctcactcctctctctggtccatgtcccaggacccagccccactgcagagcccctgtcccagcctgcccggcctgtggcttctggccagttttttcttacagtaaaatctgttttttcctcaagctggtccttcccaggcatgctgttgtcatgggaacctacagaggccgcctgggtttgggggagaaaggggttgtggattaaagccaaagaatcctgccactgctattgcagccagtgcaatagtgggatagccaccattctagccctccagaatagagccagatggtggggggccagaaggggagtttatctggaggtccactcctgccctggcctcatctgctgttgagtgggcccctaatcacttagcaccggctgagtgggtaagaccctatgattcaatactctctgccaccattcctctagcaccttttcaaaaatggagctggtactaagcactattgtttccttgtccttgtagggctaaacagaatcatggcttagagtagggctttagaattgatttactgctcctctttaccttcaagacaaatgcgcatctccagagcagagacaattagcttcatttaacagatggggaaactgaggcctcaggcacccaagtaaccacctgagtcatttagccagtgaaatgtggaaccgagacctggaacctaagtgtttggatctttgccattacccccaaatgcctgggatctctgtctcaaaaaaaaaagacctatccacagagatgtacattgcagcatgattaatgatagaaaaatcagaaagcacatctatataggggatggtttaataaattagataatacactattaaatattatacaatcattaaaaggattgcaaagtctgtgtagaaatattaaaatgttaagtaaaaaatactagacacaaaatagaatatgcaccatgattataagtatgcaaagtatgtatgcaatgaaaatatctgcttcaatttgatggggtgagattatgtgtaatttttttctcttttcgaagttaccaaaatataatactttgccttttcaagcaaaacaaaacaaaaaaaactcttgggatgatatagggttaagaactcggccctatttctgaaacgattataaagaaatgggtgcagagagttccaacatccctccctcagtccttgcctcattcatctattgagtatatattaagaataattttttattgaatatctactatatgtgtgcatatctcgtttctagttttcacaataattgtttcacaaaataggtaaattacttaggactttgttggtttcatgtaatgaaaatccatgctaactatttaaggagtttttttttttttttttttgatacagggtctcactctgttgcccatgctggatgcagagcgcagtggtgcaatcttggctcgctgcaacctctgcctcctgggctcccacctcggttccagagtatctgggacaataggcatgcaccaccacaccctcctgactaattatttttatttttattttattattgttattattttttgagatggagtctcactctgtcacccaggctggagtgcagtggtgccatctgggctcactgcaacctctgcctcctgggttcaagagactctcctgcctcagcctcctgagtagctgggattgcaggtgcccgtcaccacacctggctaatttttgtatttttagtagagatgaggtttcaccatgttggtcaggctggtcttgaactcctgacctcatgatccacctgcctcagcctcccaaagtgctgggattacagatatgagccaccacacccagctacttgtttgtaatttttgtagagatggggtttcccatgttgcccaggctggtcttgaactgctgggctcaagcgattggccagcctctgaactaccaaaatgctgggattacaggagtgagccaccacgcctggccttaggagattttttttttttttttttttttttggtttaagggtgcgggtttctcacaagctcagtgcagctggcctcagtcagtcactgaaaccaggacattaaatgtgcaagaccctttctctgtttccactgtctcttcctctctgggcctgtgcttcctttgtgcattggcttccatctactcttatgcagaccagctttttctgcttcccagccacacaggaacatatggctactgatatatagccattgggtctacagtcagtatagctgtatgggaaaagagtccagtgtgactctctctgggttccaattcctaactggtgatgtagcagctgatggtcccgacctctggcccagtaatctgtggggagtgggctgcatcgtgttggactaacatggtggccaggaaccaccatcgtctctgtgtgcatagggaagaagggtcagttctcagaaaaagcgggtgagagtgggtgggtggagatgggtcaagtgattgaaaagagaaatcaacatatggagacatggtgaatattatgatgcctctctctgcagatgaggaccttgaggctcagagaggttggttgacatccttaagtttttacagcttgaaaagaacagagctggaattctcccgcggcccggctcccgcctccctctcctccgcccggcgcctgcacgtgcgctcccggcggagccggcgccgcggccgccgcgcgcgcccccgaagggcggggccggggcgcgcgcgggcgcccgccttaaaggggagtgtccctgttaaaggggtgggcggggctcacgcctcggccaacttcgcggatcggtgccgagcccggcgcggaggaggccggagccgaacgtgcagtctcctccctctcctgcaccccacgcagtgcagaattatcttatcagagtcgatcccccgcccccgtcgaatattctacgaatcccgtgcgtgttccagttcctccatccctgcgcctagcctcaagcccccagcgcgtcccctgggatcatcgccgcggtctcctaactggtttccctgcctcgcctcgccccctgccatcctctggacgcggcagctgtgtgatggaatcgcggcacgcgccctttcagaacatagcaaagctctttattgatgacagtatgggtgagggtgccgtgtgaggcactctgattgggctggtaggtagaacccttttggtaaacaattggcattatgcatcaaatgccttaaaatcttcatatccatttacccagtattgtcccctgtcctcaagaaataataagaggacagatgtttatgaaaaatgttaactgtatatttatcattgtaaaaaaggtagaaactaagtagacaataatagaaaatgttaaattatggcccatccatatgatggaacattatttagtaatttaaaatcctgtttacaaaaactattgacatgagaaaatgcttacaagataatgttaaattaaaaaagcaaaatgcaacactgtttacagtattattcaaattgtactgataatatgtgtttataggaaaaaaagactggaaggatatttacccaatagtaacagtagttattgccataatttttttacttttaacatttcaataatttctaaatatttttcaaataaatgttactttcaaatctagaagaaatgcttaagaaagtaaacaaatcactccgtatctttctgaaaagaggtcagtttctttagcttgagaaagaacttgatataaaggaaagggcagaatttttgcagccagagaattctggatctgaattctgcttcctactaactagctgtgaaaacttgggcaaggtttgaacctctctaagcacagcttcaccatctgagatctaggggtggaaaggatggccaagagatagggagaacagttgcttaaatggaattctcaccttctaagtttcaccaacctgaagaactcccatcgtcatatccggaaaaaataaagctgaagacacactcgccagacacagtgtacacacaatcacataaagtcatggggaggcattgtctacaagttggtcagtgtagctggatgagtaaataacttattctcctctccctcatctcccccaaataggcacaccccacccagtccgtctaagtggtttccaatccatgctctatccaccaagctgtggtgcacacagtgctaggttactgtgttagtttcctactaccaaactgggtagcttaaaatacaaatgtattctctcactgttctggaggctagaaatctgaaaccatggtgttggcagggccatgtgctctctgaaggctctagggaagaatccttccttgcctcttctagcttctggtggttcccaggatccttggtgttgtttggtttgcggaagcataaccccatgtcttcacatggttatcttccctctgcatctacatctctgtccacattcctctcttcttataaggataccagtcattggattagggcccaccctaatccagtatgagtgcaaatgatcttaattggttacatctgctgctaagatcctcgttccaagtaagattacattcgcaggttcctggtagacacgaattttgggtggacactattcaacccagtacagtcaccaacccctgcagttaagaagggaaagccaacccctcaggagcacatatctgaagccaggggggagggaggtatctttccttatttcttgctaagtgctgccactgtggcttcgaggccaggggtcccagaggggacctgtggttgcttcactcctagacagtaaagtcagccacacagctaaatatacagatcagggaaccagaatgctggctccacagaccaaatgccacctccgtcagctccatcagctcacttgacagcattgaactttgggcaagatactttacctccctaaacctcaatttactcatcttgtaaaatggagctaataatagttctatgtcatacagatattgttagtattgataaaatatggtaaagcatttagcataatctctgacacataggaagtgatctaaaaagaatagctattatcatcattatgagttgaccttcactacaatcctaggaagtggttgaggcatgtcagagtgtgccccgatgaagtgactgagacttagagaaggtaagcgatttgccaaggctcacatacaatccatcattaaagccacagcctactggtcctgtgctttcttcaacaccatagcatctcctgcttttctaggtactggtcttcaggacccagctgaaggtggaaaatgaggtggagcaggggaggggttaatcatatgcctcacaccccatttgtgagagtttggggcatctccaaactagagctttcctaggtgatgtgtctaccttccttttaggtcccgcgctacatagagactgcctaatccctacctgtgcccttcgctccttcccacagcctggcccaaggatgcttcctgctagttctcctcaccatccctgaaggccccagtaagtgtccattttcgtaagccttcttttttttctttttctttttctttttttttcttttttgagacggtgtctcgctctgtctcccaggctggagtacagtggcatgatctcggctcactgcaacctccgcctcctgggttcaagcgattcttctgcctcagcctcccaagtagctgggactacaggcatgcgccaccatgcctggctaatttttgtatttttagtagagacagggtttcaccacattggtcaggctggtctcgaactcctgatctcgtaatctgcctgcctcggcctcccaaagtgttgggattacaggcgtgagccaccgtgcctggccttgtaaaccgtcttaatcttagggctggacccacatcacagtctatgaacttcttttcccctctgccctgtctctttgtcaggagagtccccagagctagcaggagccacttctccaggaaaaagtcttactccttagtcccactgactagagtgacaactcagtgtgacaattgccacattggtcgcaacgcacagagacaccactacctaggggatcatttgccttggtgagcagcagggtcattcatcccaagaaggcaatagttcatcttcactcatccattccacaagcactaagcacctacagtacaccaggcacaacatatagacatggataagtcatagtcctcgccttcatggaacttaaaatctaatacagaaaagcatgagaaaaagagcaacaacgggttatctctgcgaggacacaagcctgtaaagagccaatgagggccactcaggggacatgaatgattcagctgtgaggggacaggctgaggagttgagaaagttttcacgaagagacaggctacgctgattcttggaagatcagagagtccccccagataggcctgtgtcaggagggcaggagatggcaggagactgttctgcctggcatttaggagaaccgtgagcagcctagcggtacacccagaagatgcaggctgaagatgatggacagtggaaacgtaatgttggtgagctaggcagacgtggaagtctacttggaaatggagcacactggagtgggagtctaataagagaccctcttcagtacacttggaagggttctaagtgtaaattgatcatgtttgtattttaggaaaggctaaactgatcatatttgtaaactgatcatattgtgttaggaagatcactttgctgaaccaagtgaatttgaactttgtacagaggctggttggaggaagacaagactggttgtaaggaaaccaaagagaaggcaaagcccaggcaagataggaggtggacctgaccccaggcagcagcaatgtgaaggtggaaaagagaaacagattcaagagttcaaagacgtagaaatgacaagattgattggatacgggaaatgaggaaaggggatggccccatatgactctaggataatcttaggtgactagctgcctggtagtttcattcagcagactagaatgggcaggtttgggaaaaagaaaattagttccttggctgggcgcagtggctcacgcctgtaatcccagcactttgcgaggccaacgcaggtggatcacctgaggtcaggagttcaagaccagctggccaacatggcaaaacccctaaaaatacaaaaattagctgggcatggtggtgggcacctataatcccagctacttggtaggctgaggcaggagaatcacttgaacccaggaggcagaggttgcagtgagccaagattgtgccactgcactccagcctaggcgacagagactccgtctccaaaaaataaaaaaattttaaaaatgtaaaaactgagttccttgtcaggcatactgagtttgaaggtacctggagccacagagatgtagatttggaagttagcagcatatcattgttgttcaaacagctcaagggagcaagagaattctggaaatacagcaataccagcaaaaaagaagacagaaggaacagtgatagaagtaggaagagaacctgggaaaaatagaataatagaaaccacggcaagagaggctttcaagaggcccatagtttgtaatgttgacaagaggtcaagtaagatgaggaacaagagtctcttagggctttggtaacttctgattggtgacgtttacctgagcaggctcagtggaggatggggtgaaggcctaacttcaggaggctacaagtgggggtgaaggcttagaaacactgagtatcatctattatttaaaataacttggctctgatgggagggggaaatttggatttcctttggaatggtaaaccaggttccttgagcaaatcttcggctgaaaacaacgtaaaatgctcagtaaactagcaagaaagtgaatactcaagtaaaagactaaaaatcaaagaggaaagctaatcaccaaagctggcttttctgttcagagcctttgcatacgggtgagctcggactttggttttcacaggcaagcaggatataggggacaggagacagagctcaagctcatccaaagtgggaagtctaataacagatcctgtgcacaaggctgtgacccacaaagggtaatacacatcgtctaaggagggaccagaaataattcactcctcaggctgggcgcggtggctcacacctgtaatctcagcactttgggaggccaaggcaggtggatcacctgaggtcaggagttcgacaccagcctggccaacatgacgaaaccctgtctctactaaaaaaaaaaaaacacaaaaattggccaggtgtggtggcgtgcacctgtaatctcagctgctgtggaggctgaggccggaaaatcacttgaacctgggaggtggaagttgcagtgagcctccctctccaccctcgcccaccccggggccgcgaggctgtgggttgagctgcagaggcgagctccctcctgggcgtgccgccgccgcgagtggggtgggagcgcagagggggcctcggggttatgctttgctgggatctgggaaggaagcaggtggcagcgccggagtgagtaaccgcctcccgaggcagctagtcccgccgcctcaggaagtcctggcgccgtagcgcaccgccgcccgccacaccgggaccttcccctcgcactagcccgcccccaccccgcctccatctcgcgctcccagccgcagacacgggcgcctctgcactctcaacccctcacccacgcagaccctggcccgccggtgacctcccctgcggctcctccttctgccccggcccagcccctcccctgctgctcctcctcctgccccggcccagcccgtccaccgtcctctcatccccatggcctcgaaccccagcctgccgagccgctcctcacagggtgctgtggctccccgctgcaaaggggcgggtcctggtagggggcgtggcctggccgacttgcggggcggcggcgccctctgccggcagactcgggaacggccacactcgtcacctcgcccccggcccggctcctggacccccctggacctctctgccagctctcctctctcctggaaatgcgcctgcaggactcggaacgtgcagaggtcggtcctggccccagccgtgccacgggctatctgagggagagtcgcggcctctctgaggcttggcttcctttcctgtgaaatggctgtggtgaggagcaaacgctcagcagtgaagaaggaccctttgtaaccgcgaaggagcctgtgagtgtgaggtatggttgttatcaacgctaagggcagtcttttgccttctgcgggggtgacgaccatccttctccctgccccagccccacagtggaaggagaacataagtcacctccagagattatcacatgcagtggattgccttcagccttttttctgaatataaaatatacatatacgtattttaatacaattgtggcccttctctacgtgctgttctgtgctgcctttttttctctctctccaagtgcttaacttatgttttaaagcccagattcggccagaggggtggctcaccaacactttgggaggccaaggccggaggatctcttgagcagaagttcaagaccaacctgagcaacatagcaagacctcgtctctacaaaaaatttttaaaaatgatctgagtgtctgtagtcccagctactggagaggctgagatgggaggctcgcttgaatcctggagttccaggctgcagtgagccgtgattgtgccactggccactgcactccagcctgggtgacagagtgagatcctgtcacaagaaagaaagaagaagaagaaaagaaagaaagaaaaagaaaacaaaaaaccaaaaagaaaagaaacaaccaaaaaactagagtcagacaaacctggatttaggttcttgctctgtgactttatatttccacccttgagcaaaccacacaacctctaccttcctcagcctcagtttcctcctttgcaaaatggtggtaatgccaggaatacccacttcacaggcagcggtgaggccccgcacacagcccagtgcatgctggttagggctctccttttgcttcctgagactgcacgagctctgccttcttcatgcaccacgtggtaaggaaggagctggaggcctccgcctctcggaccttgctcactgctgcttttttttttttttttttgacagagtctctctgtcgcccaggctggagtgcaatggcacaaccccggctcactgcaccctccgtcccccgggttcaagtgattctcctgcctcagtctcccgagtagctgggattccaggcggccgccaccacgcccggctaatttgtcatatttttagtagagatggggtttcgccatgttggccaggctggtctcgaactcctgacctcaggtgatccacctgcctcggcctcccaaactgctgggattacaggggtgagccaccgccccaggcctctttcggcactgccctcaaccacatgggcctcactgttcttccggcgtacccagactttccccatctcagcgccttcccaccggtcctgtgtttccatggcctttccccgggtaggggcctttcttttcctagcttcgctcagttccctgctacattgtcgcctcctcgcagaagccgtctctggccgttccgtatcgctagcgccctctatcattcgctagcagctcacccggctctgtttttcttcattgcacttctcgttatgtgccgttctcttataaatgtttttgtctttatccctcccatagaagacacctccatgaaaggccagggctttccgaggttcttttcctctgtggttcctagaagagggcctggcacatagccggccttggctagctttttgcgtaaatgtgaagggatccaccttcctcccttataagaggtagcagtacctcctgttaccagcagagggcaccaccgtacagcacttgggggccgcaggggatcctgctgggatgggaggtatttaaaaagcccacaggcctctcctcccataatgtgggcgctcccacagctgggaccggaagcaggagggccccctgcgctaatctgccctggcagcagcgagctggcacgccctgggtgcatcatccggtgtgctctggtgcccaaggtcggaataccctcactggtggcttggacacacccctgagcagctgatgcttctggacagatcacaccctgtcccgggctctcaaaatgagggcaatgacatgagctgcactgctcgctcacgcgtttgctgtgaggttgggacaggagtgcatgggaaatgttttatgaatgtaaacatgggacaaatataatttatgcacgcctttattggtagtgcagcagattgacaacaaacgaggggagaagataaggtatttaaaggaaattgcaaggctaaatgaaggtgggaattaagacagtgaaggagaacgaagaagttaaaaataacaactacctttcaccaagagcttattaggagccaaggcagaggaaagtgatctccaaacattgtctaattatagccaacacttacatggtgctgacctcatgccaggaactctttaagtgctttatgcataaaaactcactggatcctcacaacaactcagggaggtaggtcatatcgctgtcccgttctacacaaggaaactgaggcccggacagcttaagtgactggcccaaggccacatagatagacagggctgggcaatctgcctcctggaatgtgctcttaaagccccacagtcacagccacaccaaaagggagatattattattatcattccatttcccaaacaagcaactgaggcttagcagatgtacaaagcccgcctaaagccacactgggaatatgtgtatttgagcccagcttaaccacccaccaaactaggcctgcaggagctaggaggggcttcaggaatgtgcacaggttctctcggagggcagcagcagacatacccactcttcctctgagcggggaggggaaggtgagagcacagaggctgggcagggctgatggggttgaggaagaggctgcttggtggcctcaactccatggaccgcagatggccaggcatcttctggccaggaagtgagaggtgtgttgataggcacagtggctgtccacagggattccagccagagctgtgggccccccacaaatctccatagggagactagggactgaggggtgggccttacagtgggaggtgggagcagccccatccctaccacaagtgccccttagcccagccctgacttccagcccgttacataagctgctgcatacccaggcctggaaatagctgaggctgtaccggctgggctgggagacgtgatgaatggtccccaggagcatcagctgaccgccctgtgctcctgaagtgacctgagggcctgccagcagctcgggttacccagctctccctgggaggcagccctgcctggtctgctgaggatggctctgatgtgattctgtgtctggacatttatggttcgagtgcccgcaggatggtccctctcccaagcctgagcagctaaggcagctcccagccacgctgtgcccactggcagcctctggatgctgggagccagggccttgcccagagcaagcacttggatctctgcagacagtcagcactgggagggctgagagctctgctgctctgagtcctgtgctaagggcccgcaaggaaagaggaagaggagcctgagaaactcggggtgcacgtgggggctgcaggtgtcattccagggctgcactccacccacatccccatgcctcctgtttcacggcccactctgttactgaactggtggccctgggcacaggggggcacccacacactctgatgcccactgcagagggcagagccacacacccctccagggactaggcacatacacccttacttctgagagtaacgtggctaggctcaggagtgtaggagggcgttctcccagcatatggtgatcatatgttaagaattattattatgttggtcaggtgcggtggctcacacctgtaattctagcacttttagaggctgaggtgggaggattgcttgagtccaggagtttgagaccagcctgggcaacatgatgaaatcctgtctctacaaaaaatacaaaaattagccgggcgtggtggcatgtgcctttagtcccagctactcgggagtttgagatgggaggatcgcttgagcccaggaggttgaggctgcagtgagccaagattgtgccactacactccagtctgggtgacaaagtgagaccctgtctccaaaaaaaaaaaaaaaaaaaaaaaaagaagagagaagtatgaatgattatggccatgccaattctgtgcctttaagatacctgcttaaggggccgggcgcagtggctcacgcctgtaatcccagcactttgggaggctgatgcaggcagatcatgaggtcaagagatcgagaccatcctggccaacatagtgaaaccccgtctttactaaaaatacaaaaattagctgggcgtggtggctcatgcctgtagtcccagcaacttgggaggctgaggcaggagacttgcttgaacccaggaggcggaggttgcagtgagctgagattaagccactgcactccagcctcgtgacagagcaagactccgtctcaaacaaaacaaaaaaacaaaaaagatacctgcttaaaagacaaaaagaccaggccaggcgcggtagctcatgcctgtaatcccagcactttgggaggccgaggtgggtggattacgaggtcaggagttcaagaccagcctggccaagatggtgaaaccccgtctctactaaaaatacaaaaattagctgagcgtggtggtgggcgcttgtaatcccagctacttgggaggctgaagcagagaattacttgaacccgggaagcggaggttgcagtgagccaagatggtgccactgcactacagcctgggtgacaaagcgagaggacactgtctcaaaaaaataaaaattaaaaataaaaataaacagaaacacataaaacaggccaggttcagtggctcatacccgtaatctcagcaggtgaagcccaggtgagtggattgcttgagcccaggagttcaagaccagcctgggcaacatgtcgaaaccctgtctctaccaaaaagtaaataaatacaaaaattagccaggtgtggtggtgtacacctgaggtctcagctactcaggaggctgaggtgggaggattgcttgagcctgggaggcagaaactgcagtgagtgagatcatgtcactggactctaacctgggcaacagagcaagaccctgtctcaaaaaaagaaaaaaaaagaaacacataaaataaggttatgtattgacaggttgaaaaagtgaccagaggctcgcaggaacctagccctgtatttcccctaggagcaatggttgaagatttggtaattcagttctacaattcaactttatggaactaccacaaataacaagactgtattagccccattttacagataaaacaatgaagctgatagagaggtgaagtggcagctccaggcacactatggcacagcatcctgttttattttcttcacagcactcatggactgataattgtgtttacttatttattttcagtctaagccattgcaattataagttccataatagagatttagggacttttgttcatcttgttctctgttatttccccatgccaaaaactgttccaggcacatacccaatccaatgaataaagaaatctcctatatgttaactgtgtaaatattaggtgtgatgttatggtttaaagggaaaggcagttactttcattatgctaaattcaaaatatttagggagacaaatgcaggcttaagactgggtggacactaaagaaaaccaaaaagcccagagttgcctaaagtggcactgtctctgaaccctagagagcagataaagattgcctgggatggaaacttcacagctaaaccaaagtatggcaactctacagagtaaaggaaagaaagatactctctgaaatcatatttttgcttagcacaccatttctccataacagaggagagagagcagacatggacagaaatggtgcctctgaagccaaagctcaagttaaacctgcatgagagtgaaaaactgagaacagaaactcagagcaggtatctgaacctggccatgaggcagtgcctgcagagtgagagaaatgtaagttggacttaaaaggttcccgcattcccagtccaagtggaactgatgggctgtggctgcctgcagttatgtccagcatcagaagcactggtgagaaaggactctaggattccctttttatgaatacagagaggaaaatgagattaagaccctcttacaccaactcctacaacaacagctaacacaagaactgaagacaaacaggcgagatcccagaattaatgttcactgctactctgagcaaaaattgaacagtaaacaatagagatttcaaaattataaagagccacttcagtattctaatttaaccttcaaaaattaagatgacctaaagcaccacgaactgataattccattccacctcaacaccctgtgctcctcagctattatgagaacagactgcaacccaattcaactcatgttccaaaatgcaacaagcagcttcaacaggacatgctggaagaagcagcacgtctcatcgtttactgattcatattttggtagcaaggttacaattagctcaccggtggagaataaacctatttataacacagcagtccacctgaaagacataatcatctaaaaaggttcttagaggaaaataagtgcaggttcttcctgtactgattgcagattcccaaggtccttttggataaagtcctcagtctaaccttcctgtgttcacagtcaccattctggccacttctcagcctccatgttcttatgtaacatttacatagtgccataaacatacccagagttgcgtaagaattaaaacgttgccaaaccaataaagcctaaagcaggtcactccctccagactgtctttgattagcacaggtatgctgcctagtcgacgatgtaagagcctgccagagacagaaattaacttgaggaaatctgaaaggggtctacaaaaaagcacaaaaagaaaaccacactgtgacatgctgtacgtctatcaatcacagagtatgtttttctgctccttaagataaaaaagtaacccagcattgcttattcactgaagtcagaaactgtgtctaaaaatacctccccgccaactggctatcagtaagtcagtctcacaaatgtcccaataagagtgacacaaaatatttccttatttttacagagggaaaactgaggcagtcacagaaaggttaagttacttgttcaaggacaacttgtaaggcagctaagttctagggctgaaaaccagcctcctccctccatctggctttaacctttaaccagagtagccattttaatatgttttatcacatctgttccaggagctgtttaaacaaaactaatcagaggtctctacaagactgcacttccactgtacttaaaatccatgtccactcaacaaaattacaaggcttggcttgaaattagatttttagtccgctcacaaaatttcaaaatgttcctatgagaatgtcaaatatctctcttgttgcttttgtcttaagaaatgaatgtcatgttctcctgctactaactcaattttacatttttaaatgtgaaaattccaaagccaggccttaaaacatgtacacctatcaaacggatgctatttctaactgaaactcattctccttaccactggccttttactaagtcctagttaattcattaattaatagaaacacctatcccttactgcccctcacatcaagtccaagtatcaggcatcagagctgtctggctctgtcactcctccagcccacgtaggggagcactatataggaaatgcaggggaggggaaaaaaatcaacttcttgttatcccacagcctctattttcccagaactgacgttttactttaagccctttgcagcagtggtctccatagcatacactattggcaactagacgtgtcctggaaaaaactgtagtgtctggccaagaagtttaaaggccctggagaatgtttgctggacacacaacctaatttccaatttaccaaaaaaagaaacgaactccctattttactcacccaccttaacccccacaaacatccattttaggaaggttacaaaaaaatgaactctgccccattcagaaccacttggattatcaaacattcttaactaggctcacaaccagaaaaaccccacaaacactacatcaaatcagcagggaaatgactgttaaaaatcctggatatattaggggcaggataaaaattcctatatgaggatttaaagatttatacatacacacataaaatgacaaacctagaggttcaatctcccttttttttttttttttactacccagtagagaacattatgttacacattccaaaaacatggcccttaataaggcccgacgaacatccttattcatgcaaatcattatctcaccacaaatgtcaagctctgttcatacaccttcaccatgtttctcaaaccccacagcacagatacctaagccacagagcagtgaggccgaagaacacacacgaggtgcttaggagaagcattagcccgtgaacaaagaccccgctgcacaggctccaccactgggaacaaatatcaaagccggagataatgaacttgtttttgagattccaaagtggcatggtgtcttttcttgactgtctggtttattaaagacgactgaacccacctgagaatcattatttttagtgtaagagaagagagccacagaacacactttatctcccattgctggaaggttaggggctgctgagaagtcaaagcatcaggctttgtacgtcaggagcgaatacaatcctgatcatctctcccagatccatctgtgggtcaataatcgcttcaatataactgccaaatataaccttcatctgctaccccaaggccaaaacacattcgccaagactctcttaaatgaaatattttagggtttcatctgctcttctcagcccccaaagcctcaaaaacaacacagccagcgaagtgtcccgcaaaaaggtacccgcttctacagagaggagagtgggggggtggtataaggcgagccgcagactgtggggattgggaggtaaggggtgtgtgagggtgggcgggctgggaagaggcatcgtgtaggaaggtaaataagtactgaccaagggccgggaatacagtccagtggtgggatctttaaataatcttgggggtttggagacaggttccaggatttcacctgaaaggcatccacaaagtgattaactgaatgggccccccggggtagggtgggggaggcgaggaggaaagcaaatacacctagattcacatcaacccttggggaactcggttccatagggttagggattccaaagccaggctccaaaaaggtttaggggcctgttcgtcccacttcctccaaatagcctccacggggcatgagtgccggagggcggaggggggattgccccactgaactcaagggattgagtgaaggggaaatgtgactccctttcccagaacattagggaggcagtggagggaggggaagaaacacgccaagtgcaggacctgaaggaaaggttagagaccccttcccctacagtctgaggtgcgcggactctcaacatcaggttccctcggagaggctaagaccccaccgcccgaaccccacagtcttggcgggagaaagacgccccccaggagcacctggagggagggaagaaagccccccgcccctggacacggtgaagggcagaaaccacggacctccaaatcttggagctggaggctcagactcccctctctggaacacgagggcgctgggagcgcgacccctgagaactgcccgaatccagttccgcctggaacagggctcgggtccccaggggcccggcgtgagctccgtcgccgccgggcggctgcgcctcggagatcggggaagctgactgggggtcaccccgactcctctgcgccccccacccggccatattgtgctcgtggggagggggcgcgctgtagtccagcggccgcggctcgaggcctcgcccttgccgggccctctccatcccggcccccgccccccgtcccaggactcaccctggaccccccggggcccggacccgccgctgccggcgagcaggaggacaacaagggggcatcttgctctatgaccttaagcgaatcactcaacctctctgaacttcttatctgtaaatggggatagtagtgagaattaaggtaacacatgtaaaatacagtagaatagtggttgaaaacgatgacttgaaagccagacaacctggaatggaaccccagctctgccacttgctccatgctcatgatcttgggcaagctgcttaacacctatctgccacatatacaaaagagataataatggctaccttgaaagggttgagggctgaatgagctagcatgtataaaacacttaaataagtacctgacaaatggtaagtatccactaagtattagctgctataattcattattacattgttactgccaagagatgatgcaaggctataacacagcagtggtagagagagtaggaaggagagaacaagagacttgagaactagaacataataactaaatacatgcccagagggagagggagcttcaagttccttataactcagagtattcagcttgcaaacctcccctgactgggaattcactagctctcacaacaaccagtcaatgttcaggaagttctattcagttattctgatttatttatttattttatttatgaaatggggtctcactccatcacccaggctgcaatacagtgacacaatctctactcactgcaacttctgcctcccaggctcccatcccagcctcccaagcagctgggaacacaggcgaacaccaccacacctggctaattttttgtatttttggtaaagaaagggttttgccatgttacccaggctggtctcgaactcctgagctcaagagatccacccgcctcggcctcccaaagtgctgggattaccgcacccagtccagttattctttctgctgaagaatctgtctcttagtgcttcaaaccacttttagttttagttttggtacccaaagccacacaaaataagtctcacctcttttccacaagtgagtttttatttaggggcagctattccaccaccccctcaccccttctacaggctgaaggtccccagtcctcaaaaacatgtctgttccacatcacatcttatctgcatggaatcctagcagctctcctctaagtatatttcactcatctggttgacagatggtgaatataaaaagtatatttcagtttgtgtctgccccttttaaactgttgctcagcacaggatacagggcaacggtctgtggaccgcacagagatcaggccagctctgcctctcagctggcgatcagctcgcgtctacctgtactatcaagcaccatcacgttttgtttttgtctctaccactaggcaaacaattcctatattctgcttatagggcagagactatattccattcatcactataatggtaattcctagtaccttctacaaaacaactgctcaattgatcccaacccaggaattccaggttcttccaggggttgctggattagtttctcctacatgcttggatcaagaaggagaagggctctcttgctcgttttgccctccagttttactccatccagcagttttcttcccatctagagactcccggctctggtccggctccctttcttccacgacttctccctcttgtgtcccccgcaatcgttcacacaagccacacatctcacttgtgccccaagcctgggctcctccctcattctacgtgctattttaggatccactcctccaagaagtcagtcctgaccaaccccattctccttcccacagctgccacatttggtctgtgaaaaccttgttgtcccctgccccacacagtgagcagtgagcaagcagggcccaccagagtagggtctggaaagtctcgtccctcttgtccccccgagtggcagaggctaacagccgccttctcaagcctggctggagcacagggtgcgcccattcccaccttgagtgtagagtttggagcacggattcctcaagctcggctcatgcccttcctcctcctcctcacgccctggtgcgacctccgcaggtacgcttcaacctccgcacggcgctgagccacaagagaccagctaaaagcaaaaccagaaaacttacttggctccatatcaagagactcgggacggacgcaggaaggaattcccgcccgggtcccgtatcccccgccgccactacgcgcgaacctccacagtccacgtaaccagggaggaacggactcctcgggtgtctcgggggcggcgccccgcgcccaggctggctggactcggaagctggaggagcgcccgcgttccactgccccgggggatgcccacgccggcacaggagagggggcacacggttaaaacagctcccacctcccccaaccacagtccacgaccagcctctcagatgccaccactctcccggcaggctccagaccacctgggtcggaggctgagcc

SEQ ID NO: 13406 - DNA, 56743 bp, Homo sapiens
aggggggtgtacattacgaattgactgaggaagagaaattctatcggaatgctttaacacggatgcctgatggccctgttgccctggaagagtcgtattctgctgtcatgggcattgtatctgaagttgaacagtatgtcaaggtaagaaactcctaatttcattcaaatgtgcatatggtctattctagacacttaagagtacaagatataaagaacatggagctaaaaggtcttgactgtatgtatggttcactagatactatttgctgtttcaaagcagagagtaaatgataggatacatctttttgagttttaaccatgacgttcaagaatcttttttgatatgaaaattctgagagtctgaagtgagaatttctctaatagtggtgaaagacatgaaccttcttaatggaatgtgaacataagaggtgccagtattctacaaaatgaaaactcaaactattatttaactgtgttcttcatttgcaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtgagccctgctgtctggttgaaaggtgtcacgggtagtgtaaaagcaacatttctgttagactgatattcatttgaaggataaacacgccagcaggaaagagctgatgatgtgttgtgtgctatttcaccctcaggtacaatctaaggtgaacttgaaatatgactcttggcataaggaggttcttagcaaatttgggcagatgctaggatcaaacatgacggaattccattcccagatctcaaaggtgaggacataggattctgcctctgtaaccggtctactggtgaaccccagctctgtgatgaaatactcccctctctctgaacagtcccgccaagagttggagcagcactcagtagacacggccagcacctccgatgcagttaccttcatcacctatgtgcagtctttgaaacggaagatcaagcagtttgagaagcaagttgaggtgagctctgtgcatatttaaaaatttttggctgggcgtggtggctcacgcctgttatcccagcactttgggaggccgaggcgggcggatcacgaggtcaggagatcgagaccatcctggctaacacggtgaaatgctgtctctactaaaaatacaaaaaattagccgggtgtggtggcgggtacctgtggtcccagctactcaggaggctgaggcaggagaatggcatgaacccgggaggcagagcttgcagtgagccgaaattgtgccactgcattccagcctgggcaacagagtgagactccgtctcaaaaaaaaaaaaaaaaattacactagatctctagtttaatttggcttctatagtattttgcattctaagagaatgacctgactcaacccttaaggcactcttttcttagtatggcccacagatcatctctgttacaacagcctgatgtgcttgttaaaacttagtgtaggccaggcacggtggctcatgcctgtaatcccagaactttgggaggccaaggtgggcagatcacctgaagtcaggagtttgagaccagcctggccaacatagtgaaaccccatctctacaaaaaatatacaaaaaattacctgagtgtggtggcatgtgcctgtagtcccagctactcgggaggctgaggcaggagaatcgcttgaagctgggaggcggaggttgcagtgagctgagattgtgccactgcactccagcctgggtgacagagcaagactctatctcaaaaaactaaataaataatgaaaaactcagtgcagatactgggcatctaggtttttcttttcttttcttttcttttttttttttgagatggagtttcgctctgtcacccaggttggggtacagtggtgtgatctcggctcactgcagcctctgcctcctaggttcaagcgattctcctgcctcagcctcccgagtagctggaattacaggcgcccaccaccatgcccggctaatttttgtatttttagcagagacggggtttctccttgttggccagggtggtctcgaactcctggcctcaagtgatctgcccgccttgacctcccaaagtgctgggattacaggcatgagccaccatgcccggccaagtatccttttaataacttggaataaagggtgaagcccagctccaccttgctttgtatcctgtccggggccatccggatgcagtgcagtgcaacacccagaccagctgcggtgggctctcagaggatgttgccctctggccacgatgtcttaggatggatggttttaggagaagagcacatgtgttgatcttctgtgttttgttttgtttgaggcagcatctcacctgtcacccaggctggagtgcagtggcaggatcctagctcactgcagcctcaatctcccgggctcaaacaatcctcccacctcagtctcttgagtagctgggactacagatacatgccaccatgcctggctaatttttttctttttaagtagagatgaagtcctgccatgttgcccaggctggtcttaaactcctggactcaagtaatccacctgcctcagcctcccaaagtgctgggattacaggcaagaaccactgtgtctggccagtcttacgtgttttataactataaagtgccttctctttcatggggctctaattaataatttctatcattgttatagaagaaaaaacttgatttattttttaactctcaaagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtgacggtgagtcccgccaggtggggacgcaggagactcctcacccagcagtgtgatttggtgactttctttcaagcctaaaaggccttgctgtgactgagctttctagtattgaagactcttttcctttttgtagttaaaaaagcagatggagatagcaaatgtgaaaatatgaagcccagcttagacctctttttactcagaatggcattcagtagctggttttaaggattaaagtttttctgttcttagatcattctcttacgtagatatgcgcagaaattagagtttaatttcctgtagacaaaggccaagctttccactgctgctgctagttaatttaattttggttggatggtctctgtttttgccagtgctgccagtggattgtggggaggcaggttctgttgtcttcgtcattgtagccatttaaaccttccaccacccagaaactgccacatccacttttcttcatgcattgaagtatttattgagcaccgactgtgttccaggccttgttctaggtcattgagatatagcagtgagtgaaaaggacaagagcctcctaccttcatggaatcacgctccgtgggagagagaaaaaaaatgagcaagaagagacaggaaaggcaggtggtggtgctgctgcgacagaagcagatgagagggcgctggctcagtggctactgctgtgcctgggagggtggtgtggaagggggctggcaactcatgctgatagcagaggtgatgtagataacagtgtgtgtggttactggaagtggaattcaaaattttatttattttattttttgctccctttgttatttttatttgttattttctaagagtgcatgaaattatctggagagcatataaatacaaatgcctggacccctctcccctctataaacgctgatccgataacacaaacgcctggacccctctcccctctataggcgctgatccgataatacaaacgcctggacccctctcccctctataaacgctgatccgataacacaaacgcctggacccctctcccctctataagagctgatccgataatacaaacgcctggacccctctcccctctataaacgctgatctgataatacaaacgcctggacccctctcccctttataaatgctgatccaattgggttatggtgggtcccaggcgattggtttgttttctttttaattttcaaatttttatttatttagggaatataagcatagaaaagacaaatggaaaagatgtgaacatattttgaatattaatctgtttttctcatttggggatgtaagtttcccacagtaggcctaatgacaatgacagatttagccttccacaaagatctgctggttaattgtcccatcctgcctgtaaccgtttccgtgctgctgggcccctgcaggttctactgtgtgcttaattttgatttgatggtctctgcttttgccagtgctgctgttactgctaggttatgagtgcttgctccagtggaggagttgaatattaatcaatagcaagattctggtcatcaaaatttgaatatttctcatcactttaccttggtgccagtgatgtgttagagttaaaactttttcttttttttttttttttttttgagacggagctttgctctgtctcccaggctggagtgcagtggcgcaatctccgctcactgcaagctctgcctcctggcttcatgccattctcctgcctcagcctcccgagtagctgggactacaggctcccgccaccacgcctggctaattgtttgtattttttagtagagacggggtttcaatgtgttagccaggatggtctcaatctcctgacctcatgatctgcccaccttggcctcccaaagtgctgggattataggcgtgagccaccgcacctggccaaaaattttttttgaggcagagtctcactgtgtcgcccaggctggagtgcagtgacatggtcatagctcactgaagcctccgtttcctgggatcaagcgttgtagctgggactacaggcgtgccccaccatacctagcttactgtttatttttagtagagatgaagtcccaggctggtcgcaaactcctgaactcaagcagtctccccgccttcacctcccaaagtgctaggattacaggcgttagccaccacgtccagcctaagtaaaatgttttttgatatcttgccttagtggaaaacagtaatattttgtacacctctcaacagttattaaaatgaaaaggaagtatgcaaatggtagtgttaatgctgaagtagagtctgtttctggtgatttctcattcctctcttggctgggtaactgatgtaacaactgtgttctctggggaagttgtggctggcaggccccggaggtttgtcctcttctatcactggggatgtgcacttgaggccgagtctgtgctgcctcttctcccgccttccagggtactgaataagacaatggctaaatcaagagatgctccaccattctattttatttatgtaaaatgttcatgtaaaaattaaattcgctactgtacacacatccaaagtggacatcttgttgaatgtttccttatgaagatgtgtgcaaagaatccgaaacgtccagaagccctgcaggctctgtgcaccattttaaagcctaaatgctcatctctcctgagacattgtgctccaattctctgtgctctgactgctttcagggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtatgaaccactggggagtgggtggagaatcccgctccccacccggactctgccattgactttgttcatcctcagggccctgccagattctggggtgatttctatttccaaagtcaactgctttactattctcaatcgcaggtggccttagaagaattacaggacctcaaaggcgtttggtcagaactttctaaggtttgggagcaaatcgatcagatgaaggagcaaccctgggtttcagtacagcctcgaaaggtatatcatgaaatcggtgtttgtgtacgtctattttaacagttacagactttatttaggaacgtgacaagccaagtttgtgtatttgtattgtgagttcataagatgtcatttaatgtcctgcatgtcatttacattattcgtccaaaatactgtaaaacttattttgaaaccttttttttttttttttttgagacggagtttcgctcttgttgcccaggctggagtgcaatggcatgatctcggctcactgcaacctccgcctcccgggttcaagcgattctcctgcctcagcctccctagtagctgggattacaggcatgtgccaccacgcccggctaattttgtatttttagtagagacagggtttctccatattggtcaggctggtctcgaactcccgacctcaagtgatctgctcgcccggcctcccaaagtgctgggattacaggcatgagccaccgcgcctggcctgaaaccattttttaaagaaatatttcaccatttaaagaaatgttggcaagctaaatagcatcttatgtttctctcgacagcttcgacaaaatttggatgccctcctgaaccagctgaaaagcttccctgcccggttgcgacagtatgcgtcctatgagtttgttcagaggcttctgaaaggttacatgaaggtaggtggccagtatcgcacggtgatgagtgtccattagaaacgcacctgcacagatcactttgtttactttctccacagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcaggcgagtaataggactgaacggctgctttacgttgtgtttcgggctgttacatagatctgagctatgtaaaaatggagccttgtcatctgtggtccttttggttcttataatgctgggtcccttgtgcaggtagtgaatgcccacatattgataacatgcatctttctggtttgaattcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtgctgttgctggggaagctttccctccccaccagtggtctcccacgctttcactgtaatgccttttcactgacagttactaggtacctgttttttattgtattttttgagacagggtctcactctgtctcccacgctggagtgcagtggcaccatcacagctcactgctgcagccttgacttcctgggctcaagtgatcttcccacctcagcctccaggtagctgggaccacaggcacatgccaccatgctgggctagctttttattttttgtagagacagcatctcactatattgcccaggctggtctcgaactcctgggcttaagcagtccttctgcactggcctcctaaagtgccgggattacaggcgtgagtcaccacagccagtcaatacttgtttttttgtttgtttgcttgcttttttgttttttttttttctttttttgagatggagtctcgctctgtcacccaggctggagtgcaatggcacgatctcggctcactgcaacctctgcctcccgggttgaagtgattctcccgcctcagcctcccaagtagctgggattacagctacctgccaccatgcctggctaatttttgtatttttggttgagacagggtttcaccatgtttgccaggctggtctcaaacttctgacttcaagtgatccacccgcctcggcctcccaaaatgctgggattacaggcgtgagccaccacacccgtctacttgttgtttaaaatgtgaatcagattacttcatgagatcctgatctgcgctttttcagtgagttttggcatatctgtgagtagaagggtcagcagtttacctctccctcctgtctgcccaccaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagaggtatggcctccagccagagagccaaatttgccagcggctagtgactactctacacaaaggctgacgcatgttttaatttcatttgtagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggtaagatccttgctttgacttggcctggagtcaagttgaatttcagttgtgcatttttccagtgatcttctttcccttctgggcctgtgtttgttagttttgacatcaaggattttgttagccaataatacatataatgattaccattcccttccctgtcatgcagtgattactgattgtacctaccttggattttttaaattgtcctaccttggatttcttaaatccttaatttaactatcatctaccctccaaggcagcttgcattacatctcttcagtgtttatctctggcagttttcttttttttttttttgagatggagtcttgctctgtcgcccaggctggagcacgtggtgccatctcggctcactgcaacctcctcctcccaggttcaagtgattctctttcctcagcctcctgagtaactgggattacaggtgcccaccaccacacccggctaatttttatatttttagtagagatgggttttcgccatgttggtcagacttgtctagaacttctgaccttaggtgagccgctcacctaagtcacctaagtgctaggattacaggcatgagccactgcacccagcctctgacagttttctaagtggcatcttttcctttctgaatagtttgcttaggctgaattggacagattcttttaaaaatgagttaataggccgggcgtggtggctcacgcctgtaatcccagcactttgggaggccaaggtgggcagatcacctgaggtcagtttaggaccagcctggacaacatggtgaaaccctgtctctacaaaaatacaaaaattagccaggcatgatggcagctgcctataatcccaggtactcaggaggctgtggctagagaatctcttgaatccgggaggcggaggttgcagtgagccacgattgcgccgctgcactccagctggggtgacagagcaagactccatctcaaaaaataaaaaagagttaataaagtaacttactggcccggcgcggtggctcacgcctgtaatcccagcactttgggtggccgaggcgggcggatcacgaggtcaggagatcgagaccatcctggctaacatggtgaaaccccgtctctactaaaaatacaaaaaaaaattagccgggcgtggtggtgggcgcctgtagtcccagctacttaggaggctcaggcaggagaatggcgtgaacccgggaggcggagcttgcagtgagccgagatcgtgccactgcactccagcctgggcgacagagcaagactccgtctcaaaaataaataaataaataaataaataaagtaacttactaaggcaaatgacatgaaattctttgcattcattgaattcctcttcaagatcttgttaggtaagtgtgtatcttttgccaagggctagaagaaattctgatgtgatctgaatttgggctggagattgccaccaccagacacatgttctttcccttcctgcagtttgaaatcttaccttgattcaccttatatgtgtatataatatttttgcaacttgagtgttattttaattttaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggtaaatttatgttcgtaacttttaaaacttctctcacatttttgcatacctcatttcttaaaattgtatttatttcaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggtaatctatagtagaagtgagtgggctcgtggtgaaaacgcagaccaatctttaaaatgatcctttgggatcttgtttctgtgtctttcaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttggttagtctcacacctgactccttccttaccagttagactcttacaccctcaaccacacagttaaatggaaatcatgcttgaaaaaggtttcaggtagtatcaaggagaacagtggatggtgtatggatatcctctgagggtgggcatttggctccctgtccctgttgaaaggtaatctcaggggcatgcaggggttacgcgacatcacggtagagaggaagggatcaaccttggtcaggatctcttgctctttcctgtcatctccccagagaggtggccacagcagtgctaagctgcacggcacgggcagtgcttgctgcgagccccatggcggcacgtggcagactcctaggatagacgtcagaaagctagtcttccatgatgttttagaatggttgcagaattttaaaatatttaaagccaggtgtttctgtttctttgtttttgctgcagctctgggttctgtgtaataccatctcatgagtaacatttctctcatctctgaaagtgaatttgccttttggaacatttactgaaagccattgtaactggacctagaacctcaatttcagtttaacagtccacaaacccggagaatgcactgtattgctttagtgtagatgaacttttaaagtgactctctttcttcagattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggtaagttcttccacagatctggacagatggaatcatatattaaaatgtttaaagataaagctaatgatttgaatgtacttctttttgagatggagtgtctgtcgcccaggctggagcacagtggtgcgatcttggctcactgcaagctccacctcccgggttcaagccattctcctgcctcagcctcctgagtagctgggattacaggcacacgccatcacaccaggctaatttttgtatttttcatagagacagggtttcaccatgttggccaggctggtctcgaactcctgacctggtgaccccctcaccttggcctcccaaagtgctgggattacaggcatgagtcaccacgcccggcctgaatgtacttcttaattatgtggtgtgtacattctaaaatcttaaatttgtttgcatttattactactttgatttttttttttttgagatggagtcttgctctgtctcccaggctggagttcagtggtgcaaccttggctcattgcaacctctgcctcccgggttcaagcgatctcctgcctcagtctcccaagtagctgggactacaggcgcccaccaacatgcccggctaatttttgtatttttagtagagatggagtttcaccatgttagccaggctggtctcgaactcctgacctcaggtgatctgcctgcctcggcctcccgaagtgctgggattacaggcatgagccaccctacctggccactacttggattttttaaatgagttgctttttgtagttcttttaaagctaaagatatgttttcagttaggtaatggactcaagcactctgttgcttttctttaaacaggacctgctgaactgggaaaacagagtctgtcaacgctcttggccatcagcttggacggtttgttttagtttcactgtgatgaaacctttgatttccaggtgagacactttatgggatccacctaaaatgtaatgccctgcagggatcatttggggaatatcaagctccgtacctctctcaaagccattggtcttacagctcagcgtggtttatatggcctcctgagtcctgtagtagggataggtgttattttgaagtgtttgaggtgtccagcatacatgcattgaagttgacttcagtttcatgttttcaaagttagatctttagtgtaatatttttctaaaatgtcagttttttgacgacatttttagtgcctgtgtcttggaataagcacattatggaagaggtttatctttaatcaacaaaaagtgatagaataaaaacagtagctttgtcattgagatttttttggcacagaaggaaagaaggtgttatactttacatctgtcatgataacggctgttgttcatgaagtaactgctgtgtgtaggcactgagcccctcacctgaggcgtgactctaatttatccttcacagccaccgtgggagtaggtagtagtattcccatttcacagatgaggagatgtgcatttcaaaaagatgtgacttgcccaaggccaagcagattgtcagagtcagggtttgagccccgtgaagccagcactgaggcaggtggtatggtagtctgctcaggccaccatatccaagcagcacaggctgtgtggcttaacaatagaaatgtatttcctcacagttctggaggctggggagtccaagatcaaggtgccagcggggttcagttcccagtgagggccctcttcctggcttgcacgtggctattttgtcgccacaaggcctttcctcgggatacatgcagggagagcgctctggttcctcctcctcttcttagaagggcaccagtcctgtggatcagcggccccaacccttatggcctcatttaaccttagttatgtccttacacgctctttcgctaaagacaaacccactagggttagggcatcaacatactgatttgtggcaagggagaggggagacaattgagggcacagcaggtggttttagcgcctttcttcctctcctttccaggcaatgggccggatctttgtgggcctttgccaggtgggtgcctggggctgctttgacgagttcaaccgcctggaggagcggatgctctcggctgtgtccagcaggtgcagtgcatacaggaagcactgcgtgaacattccaaccccaactacgacaagagtaagacacctcttcttcaaaaattacttagagaatgtagagggaaatgccctagtgaactaattttctacctcttggattagatataagcaagaatttagctcacaggtgctcactgttacaggcagtgtagtgagctgtggttaaagacggaaggtaagaaacccaggccaggcgtagtggctcacgtgtgtaatcccagcactttgggaggctgaggcggacagatcacttgaggtcaggatttcaagaccagtctggccaacgtggtgaaacccatctctactgaaaatataaaaattagcctgacatggtggtgcacgcctataatcccagctattcggaaggctgaggcagggagagtcccttgaacccaggaggcagaggttgtagtgaactgagatcatgccactgcactccagcctaggcaacagagcaaaactgttcccccaaaaaaagaaacccaggactgtattgcatcacagcttttagtcctcattctagggcagcagcatagagttttctatgtcctaggacaaccaaaaacctgagcagtccttcctcagccagccagatgcccccgtgctcccttagagcttgtgtgttccctccatggtctttgccacgggatgagcgtgtcctctggtgcgggcccttggtgccccctcttcattctcacatcgtcagagagccagcctccccagccacctgtctggccagtgttctgccttctgtctttggaaacaagccctatatcacgataggagcagctgtcggagaggccccagggaccacttcccttcccagttcaacacaaagtcccagcatgtggggtcagggaggttgggatgctgaaggaggcaaacatttgggtattgggtaagtgtgaaattctctcttatgtgcacagcgtagcttttaatgtttccttttatgctataataacaactttccttatggagaattccccagacctcctaaataaaacaaaaggagtgtggaggaaagcaatacttgcctttgtgatcagtattctcttaaggcgagaatacactttgttccaaagtggctcagaggtgcttggaggtttgggttttttttattttgatgatgctaggagcaggtaattcccatgatgtaagccagtaagtgtggcggcatttattccttttttttttttttgcacaatttgttgaactgcatctctatctcgagttctccataaaactcaggtgtggtgttgcccaaataaaatagtggtctctgcctctggtggcttgacctgggacacgtgcacatgaggtacatgggaatgggtccacctgggctgggagaatgtggctggtggtccccgaagaaaggccaaagagcagcccccgaggaagcgtctacttcagctccctgggagaacgagagctttgtctgttgttttagagacattttagaatgcattttgttttttttttttaacatttctagtcttaacgctatcatctcattctcagcctctgcccccattacttgtgagctgctgaacaaacaagtcaaggtgagcccggacatggccatcttcatcaccatgaaccctgcgtacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaagtaagtagcctagaattcttcataatcatgtttcttgcatatgttaaatgtgtccatttaaccttaaaatttttatatgtaatgatggtacgtctttcaaaatatccatctctggtttcttgacacttgaccctattattgcttaaagtatactgttattaaagatagcctttttttcttcttttctagactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagaggttcgttacaaacgttttgatcactcaaaccttatacgttatttaaatttacctttttaacatttaagccatgacttgtgagttcttcttgcagttcacatgtcttgggatggctgaaatagactgtaatgttgacccagtgagtcgagtgcacgaatgtgggcgagtggtgctcgcaccctttgttcaccaacagttactgatcacgcacctcctggggatgcagcgggcagtacttgagccatcgtgcgctgctcacagcccagccctctccccgtagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggtaacttggattgtttcactggccactgccctcacagaccctgctggctttagtgtctggtaatgacaaccgtgggcccttcgatgaaactgtccacaaaggctgtggaggtgcataatatgctttatgaagatttgcccaaggcctatttgaatttttgttgttgttgtttaaatgaagaggaaacaatacttaacctgaaaattttacatgatacagttcaatttctgaaaatgctaagtgcatgactatattggaaagttgtttatactgataaaaattctgcttaccagactttccagtgccagagatgaacaacctgaatcgctgatcaatacgtagtttacattctgtattggcttctttccttcctctatgtgattcatttaagaaaaagtttattgtttacacaagctgtgtgtgtttggcctgagagatgctgtacgggattgaacacatagctcatccattgggtctcttgttgtcctcggcgggatctgatgtgtccttgttgaggctgctcattggtgtctcctgtcccactggctccagccttcctgacttactaaagaactcgccacagtttggaaatgtttgttttacatgtgacctgtgtaacatctctccagctggggagtttcagtacttgcctttaataatccatagataggcgcttgtaaagccagctacttgggagagtgaggaaggagaatcacttgaacctgggaggtggagcttgcggtgagctgagatcgtgccactgcattccagtctgggtgacagagagagactccgtttcaggaaaaaaaaaaaaatccacacataatgtttcttgctcactttcacaagaggtggctgggcgaggagctgtccccattcctcctctgggatggtcactgtgctggtctgttgggccctgcaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagtacgtcttctttgatctgtgtatgtgttctcctggatatgggcgctaagtactttgctctcacaagagcagagtatacgttatttttcaaccaaagtctgagcgaattaaaggtcatttcagaaaccatcatcggtaaacatgcctcatgttaaaatcttgatttaatcagcagctattttaaaatccttcccaaccaggatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaatgtaagtagccttttgtatgtcgtcaactgaataattccttttggccaactaaacttcgtgtgctagctaagtgcagctctggagtcatggacccagattccatggagtagtgatcattgtgtaagtaattttcaaagatagcatctcaactgctagattttttttccatttccatggctagtgagaaacattttaataggttttattgatggctttctatcatttattgagtaataagcacactctatgattatcagttaaccctgtatggtggggttgtcgttaaggtttcttaagctgttatacatctagagagctgggaaaatgagaaatttggaatggggctttctaggctgtcccttggaaaatgagtgcatgatgcaggtgcctgacaacacctactgatcagtaaacacagtcaggcccggtatggatttgcactgagtcagaccctgttctagatgctgaaaatacagcagttagaaagcaagaagacaggccgggcgcggtggctcacgcctgttatcccagcactttgggaggccgaggcaggcggatcacaaagtcaggagattgagaccattctggctaacatgatgaaaccccatctctactaaaaatacaaaaaattagcggggcatggtggtgggtgcctgttgtcccagctactcaagaggctgaggcaggagaatggcatgaacctgggaggcggatgttgcagttagccgagatcgcgccactgcactgcagcctgggcgacagagagagactccgtctcaaaaaaaaaaaaaaaaaaaaaaaaggcaggaagacaaaagcccttgctcacgtgtgatgcaattggacaaacaaaatgaatagtgattggtgcaaagaaaaaaatggaaagcgagctgtcaggtgttggtgggggttggaggttaaaatgtgaagccttccctgagaacgtagtttgagcagacacttaggggagtgagggagtaggtcccaagtctcccaagtattctgggcaaaggaacacacagcaggagtagcaggtctgggacagggggccggtgtacttgaggacagcaaggggcagtcggctgaagcggagaggactggggaggacaagtcagggctgagactagagaggaaacgagccaggtcaggggcctaggaggtcattgtcgggggtgtgagtttgtacactgggcaagctgggatccatggagcagcctggacaggagcgatgttgcctgatgtatgtccatgaagatccgtctggctgccgtttggagaatgaagagggcagggtgaaagccaggaggccagttggagactgcctcagacctccaggcaccagggacggggcgagctggcagcagcgaaggtgctgagaggtgactgactatggctggagtttaaagcatgcgtgggatttgctgatggactagatgtgggtgtgagggaaaggaatcaaggatgatgcgaggtttctggcctgatcagcttatgagcctttaacaacaaggcttaggattggtatttatctcagcttcaggagccagccatggattcttagtactgtctgaaagtgtgcacttactccaacaactcaagttcctctctgacagctgatccagtagagtctaacttgtcagaggagattaatctccttgtgaggcaattacagctccgaggttaaggctctggagtccgaccacctgctttgaatctcaaccacttactagcagtgggaccccagcaagtcacctgcgccatctttaaactggaggtgaggctgggcatggtggttcgtgcctgtcatcccagtactttgggaggccaaggcaggtggatcatctgtggttaggagtttgagaccaacctgaccaacatgatgaaaccccgtctctactaaaatgacaaaaaattagctggcgtggtggcgcatacctgtaatcccagctactcaggaggctgagacaggagaattgcttgaacccgggaggcattgcagtgagctgagatcacgccattgcattcgagcctgggcaacaggagcaaaactccatctcaaaaaaaaaaaaaaacaccagagacgacagcgtgcctgcctggtcaggttatgtgagactggagggatccacgcccggtgcgcacccaggacacagtcactgctgacatcacacttggaggggctgttgcttctgtgccctcaagaacagtgggaaaccttaaacaaggtggtttgccctattcttctccctgccacacacacttgtcctgcccagattcctgtagagagaatggtgaatactgtagtgatgtgagctgtaggtgttttttgttttttttacataagtgcagaaaaaatttttttgagacaggttttcactgtaacccaggctagagtgcagtggcatgatctcagctcactgcagcctccacctcccaggctcaagtgattcttctccctcagcctcccaagtagctgcaattacaggcacacgccaccatgcctggctactttctgtataggaaaattaagtttaaagtcaccctttcagtgtatatataggtaaaagaatcttaatgtccaggtttcttccaaacctatgtcattaaatctgcttaatgttttctttcaaggtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcacatcccgctggatgaaggggaggatgaggcacagcggcggcgtaagggcaaagaggatgagggggaggaggccgcttcccccatgctgcaggtacgcccaggtgggaccccacatatcatgacctgagggtgctaggatattcagatgtggtctcgctgtgttgcccacgctggtcttgaactcctgggcccaagcaatccacctgccttggcctctcaaagtgctgggattacaggcatgagttactgtacccagccaacttttgtgtaatcaatgttgtcttctgccagcttaaacaaggaagcccagctgtagcagctacaaatgttaaaagtcacgtatgggaaaatttaaagaattcttttcattatcttacttttctctacaaattgatgaaagactgcccttttccatgttcagtgggaaaaccaaagttcctgggaagcagggtttttgagaaccaccagggtgaaggaatgaggactggtcattgaagcttcatccaaaatgagttttccaaggtcgtatgaccttctcctgggaccaggttagaatcgatgaaactcgcctgccttttgaaagatagttaagtatcactccttccactttctagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgagcatgcagctaccacccgtgtttctgattctcgccttgttgatttaactcatcctggaacaagctgaccatggaccttggcttcgtcttttcattttattccatttcatagaaggactttatccttttagttccatgtgttagcaaagagtgcagattaacctgaccaattacttccttgttctgaaagttcaagtttgtgttcaggtaaacaaacctcgtgaggaggcaccttggttgcagccggactcacacttccatctccgtgtgtaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtaaagaggccaggaggtgggcagcagaccttttggtgctgagcatggggttggtcttacagtgtggttttgtgtcttccctccaaaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacaggtttgtttctatccacaaggcccttcctgccccacaatgtttcttgttcaagttttgctcttaatgtggtacctgtcccttccttcagatggtggagcacggaggcttttaccgtacctcagatcaaacatgggtgaagctggagagaatccagtttgttggggcttgtaatccccccacagaccctggaagaaagcccctctcacacaggtaaaacagctcggtagactgctctgcttcacacacgcacagctccaggattgctgtaaacacagcgccacaaaaacctggttttgataataaagacaacaatactgcttattgtggattcctcttgggttacttctctgtgctgtaatgccaggaaaacatgttaaaaataaaagcattggccgggcgcagtggcttacgcctataatcccagcactttgggaggccgaggcgggcggatcacgaggtcaggagattgagaccatcctggccaacacagtgaaacctcgtctctactgaaaatacaaaaacaaaattaaggccgggcgtggtggcttacgcctgtaatcccagcactttgggaggccgaagcgggcagatcacgaggtcaggaggttgaggccatcctggctaacacggtgaaaccccatctctactaaaaatacaaaaaattagccaggcatggtggcaggtgcctgtagtcccagctacttgggaggctgaggcagcagaatggtgtgaacctgggaggtggagcttgcagtgagctgagatcgcaccactgcactccagcctgggcaacagagcaagactccatctcaaaataaataaataaataaaataaaatgaaataaaagcattgatctcttggtagtgatgaactgctccagactcatctgtagagccaagatgagcctgaaataagccttggttattttttcatctttgctggtttttcaagtgttttccatcgactgttgtgtgtcagaccccaagcctgagcagcgtgtgtgtgatctcagctaacactgatgtcaagtctgcatagctgggttaggaagcgacctccagacagggccctggacagggcgactccactggcacactgccccttcctgggaggcgctgtcagggaggggcgctgagcggggctatctgtgcacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggtacgcagagtttctttgctcttccagaaattgttttcctctcataattaaggcactcgattggtcaggtgtggtggttcacacctgtaatcccagcattttgggaggccaaggtgggtggatcctttgagcccaggagtttgagaccagtctggacaacatggcaaaaccctgtctctacaaaaaataggtgggcgtggtggtgcatgcttgtaatgtcagcttcccaggaggctgaggtgggagagttgcttgaacctggaggcagagcttacgatgagccatgattgtgccactgcaccagcctgggtgacagagtgagactctacctcaaaataaaatgagaagtttattgaaataaagattggactttattcagagatgttattgagccgagagactttctccaaggtctgtcatcaaagtcacttttctatgcaggtgctaagactgctgacatttccatgcttaatcattatcctatgcatgtgtatgtatgtgtatatgatgaaaatagagccatacagtttctaaatgtatataaaggctgcatatctgccagattgctctcaagatggttggaccagctacgcctccaccagcagcacccgcttccctgtattctgcaacatttaaaaaatagtcattaacaaaaatgtctttgcccatttggtgagaaatgactctcgttgctatttgcatttctctgttgagcctcccatggagccgctggctgcgggggatgagtgggagccgccaactgccctgctgtgtctccctcgctcttcatgctttgggacagctttcttgtcataggtggcagatgctttttcccagtatttaatttgcttttaagtattttcagaaggattttttgtagtttcattgtttaaatatttaaatcgttaaatataatgtatttcagcataaagtgagcagcttgaatctaactttgttctggacagttatttatccaattgttccaacattgtttactcatttggagacggagtctcactctgtcgccaaggctggaatgcagtggcgcagtctcggctcactgcaacctccgcctcctgggttcaagcgattcttctgcctcagcctccctagtagctgggactacaggcacccaccaccatgtccagctatcttcttaaatatttcagggtctaggttctttaatgtaaacatgttttgccacattttaccttttgaccacttctctgtgtcttaagatatttacgtgtaccttccatttttctcattgccataggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagataggtaagggaagccgaggatccagttggtcccattctcccctgctctgagttcttacagctgtcgaagctggggtctttgcaggggtggtctgcctaagttagagccaggtggtgccagtggtggaaggagcagagtcagccagggcagcctcccgtctggacactggtcacagttgccccagggtaacaaagtcacagtgcgctgaatgcaccggctggcccaccactgtctgcttacacaaggcactttcataaaccttgtggctgtgaacagggtacttttttttttaaagatacatcatagaagtcaaaaaacggggcactttaataaaccttttaaactgtcaggtgggaccacaaaaggtagcagctgcctgtgataaccttaccagagcacgggttcactgctgagttaaaaggtctcccaacaactgcccagtgtgcgtgttccgtaaccaccacccctcttcctgtttctcagtctgtgttctcatcaaaggctttgcagctgcagctctggggcactggttttctcttttacctgttgcccacttggatcaattcttgtcttgtaagttttgagtttttctagttaagtgaccaatacttaagggaaaaaattgctaacggatgactgatcggcatcaactgtggaaggttttgtggtttgaattgcagtaagatgacttggcagatggttccctccagactaagaaatgcttaagtgtttggcagctgtgcctctggaccaggtgtcatcctgcagtttttcctgtcattactgtacaaggagtctcagaatactgcctagttgtaatcactgggtttccaacccgagtccttggcattcttgggcaacaccgggtacattactgacagccactgtaagagatgagcaggcaaggcagagtgcagagtatgttggctgtggcagccctgtttttatttcttattggagttctgctgctttttaaacagtcttttgttattgttgctatgtcagctaccttcactctccccttttcaattaaaaaaaaattggctgggcatagtggttcacatctataatcccagcactttggaaggtcgaggcaggaggatcattgagcccaggagttcaaggccagcctgaccaacatagtgagacccccatctctacaaaaaataaaaaattagccaggtgtggtgacgtgtacctgtagtcccagctacttgggaggctgagacaggaagatcgattgagcctgggaggctgcagctacagtgagccatgatcgtgccactgcattccagcctgagtgacagagcaagaccctgtctcccacaatatagttttcacagatttctagtaccacagagaattttgtttaaattcaaatgtcgcaacagcagttgtgcttacaaattcagattggcttcagtaagtatatacctgccttcactagaccctcacctggtagcctgcataggagatcttacagtcagcttctcaaaaggtcctcacacagcagcgcagtcacagtctcgcctgcttgccttgtagtaagtcttacacctctaaaactacacacatcacagttcccatttcttttttctttttcttttttttttttttttttttgagacaagagtctcgctttgtcacccaggctagagtgcaatggcatgatctcagctcactgcaatctccgtctcctgggttcaaagcaattcttgtgccccagcccccagagtagctgggattacagacatgtgccaccacgcctggctgatttttatatttttagtagagacagggtttcaccacattggccaggctagtcttgaactcctgacttaaagtgatccgcctgcctctgccctcccagagtgctgggattacagcttgagaccagcatagcgaaaccccatctctactaaaaatacaaaaattagctgggcatggtagcatatgcctgtaatcccagctactgaggaggctgaggcaggagaatcgcttgaacctgggaagcagaggttgcagtgagccaagatcgcgccactgcacttcagcctgggcaacagagtgagactctgtaagtaagtaagtaagtaagatcgcgccactgcacttcagcctgttgccaggctgtaagtaagtaagtaagagtgagactctgggctgggcgaggtggctcacgcctgtaatcccagcactttgggaggccgaggcgggcggatcacgaggtcaggagatcgagaccatcctggctaacacgatgaaaccccatctctactaaaaatacaattaaaaaaaaaaaattagccagccttggtggcgggcgcctgtagtcccagctactcaggaggctgaggcaggagaatggtatgaacccgggaggcggagcttgcagtgagccaagatagtgccagtgcactccagccttggcgacagagagagactccgtctcaaaaaaaaaaaaaaaagtgagactctgtaagtaagtaagtaaataaataaataaataaaatttcaggttgcctaagctgtcatgagttcagcttttaggttcatccatgcatagtaaaggaagatgtgtgataaagactgactgcatcctttggaagagcccacagcacccacaaacatggtgaacatggtgcttcttcaccgtgccctctagttacctaaatgcacatgctgctctccccacagactcgtagaggatgaggagaggcgttggactgatgagaacatcgacacggttgctctgaagcacttccctaacatcgacagagagaaggcaatgagccgacccatcttgtacagcaactggctgtcaaaggtagcaaactcgcatcatttcagacatacttctttttctgccatccctttctaacactaacgaattctaacgaattatcttctactcaaaaatatctttaggctgggtatggtgtctcacacctgtaatcccagcactttgggaggctgaggcaggaggatcacttgatcccaggagtttgagaccagcctgggcaacatagtaagactccacctctacaaaaaaatttgaaaatttagccaggcaaggtaactcacgcctatggtcccagcaacttgggaggcttgagcccaggaagtcacagtgagctgtggtcacaccaccatactgcagcctgggtaaaagagcaaaaccctgtttcaaaaaatacttcagaaaacaaaatatcagccgggcgcggtggctcatgcctgtaatcccagcactttgggaggctgaggcggtggatcacctgaggtcgggagttcgagaccagcctgacctacatggagaaaccccatctctactaaaaatacaaaattagctgggcgtggtgacgcatgtctgtaatcccagctatttaggaggctgaggcaggagaatctttggaacccgggaggcagaagttgcggtgagctgagatcgcgccattgcactgcagcctcagcaacaagagcgaaactctgtctcaaagaaaaaaaaaatacagcgaggtgcaatggcacacgcctgtaatcccagcactttgggaggccaaggcaggcagatcacttgaggtcaggggttcgagaccagcctggacaacatgctgaaactccatctctactaaaaagacaaaaattagccaggcatggtggcatgtgcctgtaatcccagctactcaggagtctgagaatcgcttgaacccgggagacagaggttgcagtgagccaaggtcacgccactgcactccagcctgggcaacagagtgagattccgtctcaaaaaaagaataaaaacttaaaaagagtccagcttgggtaacaaagtgagaccttacctcaaaaaaacacttaaaaaacaagaaaaatctctttgtcctaaaatgcactataaaataggctgcggttacagcagtgatgtgctacgggtttgcagtcactgatactttagggcaggaattcccaggagtatggctggctggctgctgttggggttctgacttctgtgtgagggtcgagccattggatttccagccggtggaaggtgttgcttcagcgggtttgcagtgaaagaaatctttgcttcacaaatttgttttcacattcctcacactgaaaataggacaattgtgaataacttgtgtgaaaatgtttcatatgctaaaatgctagatggagttcacctctccagaatagctgtgagttgtcctttttctctgcaaaggatgaggacgtttaccgagttacagtcttgacatgcatttcattgaggagccccaggtgatagacgtgagtaagagcttcctttaggcagctcccactccagtggaggaaagagcaggacagagggagaaaactcaggctgggaagagatttctgggagaatgacccttgcactggtcttcgtgtgtttaggtcttctgaatggctttcagtgaagttcagctttctccagaaaggttcaccacgtcagggagggcatacaaggcagagcgcctgataggagctgggagtagtaaggtgggtgtgttcaatattggtagaattttctatatattttaagactctaggtacccattctttttcatttacaggaaacttctccctgtggcttatcttttttttttaactctttttttttttttttttttggagaaggagtttcgctctgtcgcccaggctagagtgcagtggtgctttctcggctcactgcaagctccgcctcctgggttcaccccagtctcctgcctcagcctcccaagtagctgggactacaggtgcccgccaccacgcccagctaattttttgtatttttagtagagatggggtttcaccgtgttagccaggatggtctcgatctcctgacctcgtgatcagcccatctcggcctcccaaagtgctgggattacaggcatgaaccactgcacccagccatttttttactctttataaggtcttttgaagaacaaacgttcttaaagatgtatctttcaggctgggcacagtggctcacgcctgtaatcccaacactttgggaggccaaggtgggcggatcacctgaggtcaggagttcgagaccagcctgcccaacgtggtgaaaccccgtctcgccgaggcaggtggatcacgaggtcaggagttcaagaccagccttaccaacatggtgaaaacccatctctactaaaaatacaaaaattagccgggtgcggtactgcatgcctgtaatctcagctactcaggaggctgaggcaggagaatcacttaaacctgggaggcagaggttgcagtgagccgagatcgcgccattgcactctagcctgggcgacagagggagactctgtctcaaaaaaaaaaaaaaattgccaggtatggtggcgtgtgcctatagtcccagctacttgagaggcaggagaatcacttgaacccaggaggcagaggttgcagtgagctgagatcaggccactgcactctagcctgggtgacagagtgagaccctgtctcaaggaaaaaaaaaaaaaaaaaaaagatgtatctttgaaactcttaatcacatttctaattgagtttgtgtattgagtgagcagtgggtccgttttcagttctttccttatggacacccattatcccagcaaagtttattaaataataatttactctgcagtatctgtctgtcatcatagtttccctgtgtgcataggtatccgttagttgttctctgtgctaaaaccacatggtcctgattatggtaataagtctgtttaatagggcaggcccaggccaggtgcggtggctcacgcctgtaatcccagcactttgggaggccgagaccggcagatcacaaggtcaagagatcaagaccatcctggccaacgtggtgaaacccgtctgtactaaaaatacaaaaattacctgggcatggtggtacgtgcctgtagtcccagctacttgggaggctgaggcaggagaattgcttgaacccaggaggcggaggttgcagtgagctgagatcgtgccacagcactccagcctggtgacagagcgaggctacaaaaaaaaaaaaaaaaatagggcaggccctcacacctggttcttttctggagggatctttcctgttccaaatgaaatacagaaatggcttgtcaggttgcaccaggacaataagcacctcccaccactgagattttgactgggattacattgaacttatggatgagtttgatggaactggcatttttatagtagagtgtttttttcctccatgatcatggtatgtctcttcatgtattgaggtcctcttcattgccttttggtgaagttcagttttctctataaaagtttttcatgtttttagatccattcctagtgaatttatatttttttgctatgttataaatgataccttttttgttgcatttttaacagtttcttcatggtatgtggacatacagttgactttggtctaataactaacatttttttctaagtaatttgggtattacctttttttctataggattacatcccagtagaccaagaagagttaagagattatgtcaaagctaggctgaaggtcttttatgaagaagaacttgatgttccgctggtgctgtttaatgaagtcctagaccacgtgctgaggattgacaggtgggcttttttgttgttacagccccacctctcgcctaagctgctcttgagtaagtgtgtgtgccgggtcacaccaggcctcatgctgtcctaccacctccacctcagccttctccaccaagcagcttcccccttctcttctttctaagtccagcttaaccatcctcagtttatcctaagcagaacttcattcttcctcccccagcactgcatacctgccataattatggccctttgaccttctgctggaattgcattagtctctcatgtcagtctagaggacaggaccgtgtcttactggtctttgcattcctcctggacttcacaaataacagttgctcagcaaatgtttaatatacaagttcaagttaaaacatgtccaaaatactgtagacactagatatgagtcaaaaggggaatgaggcattataagccttaacattgatcagttctcgtaatgtttcagaatattccgtcaacctcaaggccacttgcttctgattggtgttagtggagcaggaaaaactaccctgtctcgtttcgtcgcctggatgaacggtttgagtgtgtaccagattaaggtgcgtctggtcggtggcctcttaatcccagcaacagatgtgtgtgcagagctcagtgagtaggaatggacctaacttgcctctgcttctgtaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtaattaggtgacgtgttgcgttgcattacgtgttaccgggggaccagtaagtcagcactgtgctgtttcccaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtacgtgggcctttacttggctctgggtcaggaaagtcggtgtccttccaagggacaaagcctgcccctcatagctgtcctgaaacatgggcctctttctcaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggtgggttcagttttgagatcaacagataaaccacaaaactaaccatcatgctaatataaaactaaattgctataaaaatagaccttaaggccaggtgcagtgactcatgcctgtaatcccagcactttgggaggccaaggcgggaggatcacttgaacccaggagttcaagaccagcctgggcaacatggcgagaccccatctctacaaaaaatacaaagaaaattagccgggcatggtggtgggcacctatagtcccagctactcaggaagctgaggtgggaggatcacttaagcccaggaggcagaggttatattgagctgagatcacggcactgcaatccagcctgggcaacagagcaagacccagactcaaaacaacataaatagaccttagggcacttcatgtttgacattgtactgttatttgtaaaggaaatacttgtttcttacctcttacctctttagtaacatctcattcttgtcactgggctgtaaattctggagccgtctaacactttagtgcccccactgactctgcctctgataaaatgatctcctttgcctttgtctcccactgctgctgtatgttcaggcccttactctttcctctagatcaggaatcagcacgctttctctttaaagagccagatcataaatgttttaacctttacaggtggagtagtctcgggcacagctactcagtgctgccattgtagggcaaaagcctccagagaccatatataaatgaatgggtgtggctgtggccagtaaaacctcattactgaaaaatgcaaggcttggcctgctaaccatgttttgctaatccttgctgtagattctgtgtgatagaagaattcagtctactcctccctcccagaagagctttgtgaaatccactctgagcttgtaggtgtcctgctgcccagcccctgcaggccatctccattgcccttggaatgtcgtccagccctggcttcccctggtagtctgatcatcttgctgtgcttcagaaatcaagggaccagagcagtttctcacatcaggcctgccttgcccctttcttgtcatttcttactaataaaaggtggaagcaggctagctaacctttctatagtaactgacatttgtgatgccttttcacataagtacacctctaaagttggtgtaatcaccatcctcagtttagagaagttaaagggcttagagaggtttggaagtgtaaggggtatctcgaaagctctaagtggctaagctgaggcccgactcgagtgttctggccccgagggccaggctccttctatcatgtcacacccatctgccaaggccaaaattgttttctgaggttaagtcacagagtttcctgaagagtgagaagatgtaactattttctgaaaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtgcgtcacaggcacaaattcctcacgggagtgagctgcagtgaggacccctttccatataatttctgcatgtttctcgtctctgagtgtgggctttgctctttaggtagaagaactgcgtcgtgacttgaggataaagagccaagagctggaggtgaagaatgcagcagccaatgacaagctgaaaaagatggtgaaagaccagcaggaggctgaaaagaagaaggtatggtgtcagggaattctggcctgtaaggactgagcattttcagtctccaatgagagagtaggaaatgtagttccaaatgggtcttagggttagagagagggagggagggagagagagtgtgtgtgtgtgtgtgtgttggcagagtgaagaatgttgtttagaatttagtcagcaaattaaccaatgcttaacccatacctaagccatccctcctttctaggttatgagccaagaaatccaggaacagctgcataagcagcaggaggtaattgcagacaaacagatgagtgtcaaagaagatcttgataaggtggaacctgccgtcattgaggcccagaatggtatgtaaagactgtcagagctttgatgtctaggaagggtggtctccgtcaacattactgtggagttcaggtcactgaacattgcacatatgcttccctcaaaggttctggtttccaaaaatatcattagtaaccatctgaagctttttctgaatgcttgagattgtcttcatctctcaaagcaaagttcctacaaagctagattgtatttaccatagtgaaacccctctcataaaagaaacttcacaatataagctttgtgtcaatatacgtttttagagatctgttgataattacgtaagtatgctatttatcaatccctgacttgaatttcacccagaaatataaaatattcagtgtaactgtcttgtaattgtttctgagtgttctagctatgacccaattgctaatttaagtattgatagcagtcacttctctttttccattccttacatgcctataagatgctatagaaatagggcaacaacctgccatcctgttttagtttgcaatttacacagtgagtaagactgctctcagccaggcgaggtggctcgcactaatcccagcactttgggaggccgaggcaggaggatcatttgaggcaggaggaccatttgaacttaggagtttgtgaccagcctgggcaacatagctagacccccatctctattttaaaataaatgaataaatgaaaacaaaagaaaaaaaagagtgctttcttcttgcccactgtatttaacctgtttcaaataacccaattatctgtagtttttaccttatacaacaagatgaattcaaatgcaccactcaacctatatattttcattcagagttggatttggatgataatttaatgtagttctcaccttctaaatattacttaaaattgttttacaaaaatttcagcctagaaaactattttagtgtatagaagtcattggccattgtttttgttttgctttgtttgagacagggtctcactctgtcccccaggctggagtgtagtggtgcaaccatggctcactgtagcctcagccttccctgtttcagatgatcctcccacctgagcctcctgagtagctggaactataggtgcgcgccgccacacccagctaatttttgtattttttgtggagtcagggttttgccatattgcccaggctggtttcaaactgctgggctcaagcgatccacctgcctcagcctccagaagtactaagatgtgtgagccactgtgcctggcagccattgttttagaactgttaactccacgtctttacgcatccctctaaattgtagcaaatttaaaatgtctgttgaaattatataaaataaatgcacaattgcacttaaaatattttgtaaaatatttttttaaaatatttttggccaggcgcagtggctcacgcctgtaatcccagcactttgggaggcaggggcgggtggatcacctgaggtcgggagttcaagaccagcctgaccaacatggagaaaccccgtctctactaaaaataggaaattagctgggcgtggtggtgcatacctgtaatcccagctgctcaggaggctgaggcaggagaatcactagaacctgggaggcagaggttgcagtgagctgagatcgcaccactgcactccagcctaggcgacagagctagactcagtctcaaataaatagtaaatatattcttaatctttatggggataaagaaattaggacttgtgagacattttaaaggtaatatcctgctttttaaggaatgctagcattttgtaagatcttcataatcatttaagagatcagctacttaccctattccagagggtttaatacagaaaagtctctcatttcttagctcttctaagcagctagctgtcctttctctcattggagttggagctcctggctgttttggttcattctcaccatgctttgctctatcttctcccacccatcgaccctcatccactcctgctgccactcagctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcaggtgagaaagtggaagtgccaaggtattgccagaaattgaaatcagttgttcaggccaggcacggtggctcacgcctccaatcccagaactttcggctgttcaggccaggcacagtggctcacggctccaatcccagaactttgggaggctgaggcaggtgaagtgcttgagcctaggagttagagaccaacctgggctacatggcgacaccctgtctctacaaaaaaatacaaaaatgagctgggcggggtggcatgcgcctgtagtcctagctacttgggaggctgaggtgggaggattgcctgaacccaggggatcaaggcttcagtgaaccgagatcacaccaccgcactccagcctgggtgacagagaaaaaccctgtctcattaaaaaagaagaaagaaaaaaattgttcaagtgttgagcacattttcagctttcacctgagaaccaagggtcagtctagctcatccccagtggtcagtcactggggcaatgagatgggagctggctctggtctcttccattttaattttatgaaaactcttccttgcttttgtcctgcatgtgtttagaaatatcattcgtcttttacagtgacgccataagggagaagatgaagaaaaattacatgtccaatccaagttacaattatgaaattgtgaatcgggcttccctggcttgcggccctatggtgaaatgggcaattgcacaggtgattaacacagccaggagctcccgtgtgaaaggtgacctcttttcctgtcacttaaataacagttatcaattggttcttcccagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaagattatcatcattgatcctcagcctttcctgctgtggaagcagagattaacacacttcaacatgcgctgcatgcaccatgctggcctcggtgaattcgctctttaacatctgtaaggccccggaggacttttttcctggaaaataatacacactgagtagtcactaagtgttgttaattaggatagattgatacaaactggacacttttcagccgttgaatcccccaccagcagctccagacctgtttgctctgctgcctgagggcctcgctccgtacccagcttctgccccgctgagattctgagtcgtgtgtggtcattagttatatatgatctgggtctcatctcctctgggactgtgaacaacttgggcacgtttctaacccacccaaaaccctgcacataatgtggatgaaccgatttgcaggattcggtataaatcctgaaaggcctcatccctgagcatcttgttcggttttccttttaggtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccaggtgagaatcacggggagttcaaaaaggatgtgcgagcagtgtgaggcaagctggtgtttagtgcacagttagagtcttgagaacagtcccatctgtggctgtgaagaggaggaaaggtaacggccttgcctttcagttccgtacagatattgccaggacggaatacctttccaatgctgatgagcgtcttcgctggcaggccagctccttgcctgctgatgacctttgcacagaaaatgccatcatgctgaaacgattcaataggtatgagctcgggtgccaaggagaggcatgggaggaatgtgggtggtgatcttgaatttttttcaaaatacacccttgtttgaagagaggaatagaaaatggggcgtgggcatacagtgctggcagcttggtgctcctctgatggtggggcgtgtgctgttctcgttattgtcaagtgtctgagttattctgcagtgaatgcttcttgtaaccttctaaaatcgattggcaggggccaggcacagtggatcacgtgaggtcaggagtttgagaccagcctggccaacatggtgaaatcctgtctctactaaaaatacaaaaaaattagccaggcgtggtggcatgcgcctgtaatcccagttactcaggaggctgagacaggaaaatctcttgaacccaggaggcagaggttgcggtgagccgagatcacgccactgcaccccagcctgggcaacagagtgagaatccatctcaaaaaaaaaaaaacataaaaataggccgggcacagtggctcacacctgtaatcccagcactttgggaggccgaggtgggcagatcacgaagtcaggagtttgagaccagcctagccaacatagtgaaaccctatatctattaaaaacacagaaaattagctgggcgtggtggcaggcgcctgtaatcccagctactcaggaggctgaggcaggagaatcgcttgaacccgggaggcagaggttgcagcaagccaagatggtgccactgcactccagcccgggcgacagcacaagactccgtctcaaaaaaataaaaataaagtggattggcagggttgtgtttgggggtggacattcaaacaaacagtcctctgttacaagaactgaaaatagctagttaaaggggaagtactacctgtttttctgcttaggaaagacagaataagaaatgggatgtaactgcagtgaagatgggctaggtgccgagagggttccacgtctcaccgggtggtgccagcaagagtatgaatcaatcagtacagcctgtgcgcagggctggatttgcctaaatgaccctttgacctaggagttccacttctaggtgttcattcaacagtagcctggcctaggtacagaatgtgtgtaggtaccaagtgtgtaccagctgaagactggagataactcagatggccctcctgagggcccaccacgccgtggtgctgggtagtctttgccaacacaggacattcgaatacaggctggacaggtgcagagcggacagtagaggcctcccacgaggccacaactcccacactgacacatgtgtctgtaaatgcttagaccttctctgtaaagacaggcgaaaaactggtaaaagccatcacctgggcaagggactttggtgaccaaagaatagggtcagaaaggcagggcagcatggttcttctcaccatatgcccttttatagttgagttttgtaaaagcttgtgtgtatattaccagttgggtttttttttaacgttttaactggctagaccgtaggtagatcacattagcttatttgtgtcctttcctcatttgtagaatggttcgataacagtgtcagcctcatagggctgttatgaggattacgtgacgtagtgtctgtaatttgacacggtccttggcaattaaaattctgtataatgttaatcccttgctgctgcgacatcattgatgttgatacgtgctgtctagaaggatcgtaaacatgaaaaagctattctaacagtgcaggatgctgagaggatgattgtcccagaaggaaaaagatttttaactatggccctcttggtgtatgactcaagctacctcctcatgccaatagttgttcaaaaggatgaggtgatgttagcattaagcatgttagctttattggtaaacctgaaaacgtctccggaaaccactctcgggtggtggtaacagcctatcaatcagggtctctcatcagggactcggctaaccgtgatcctgtgctttccccattcggtgtttcaaccttctcttctgtggcctcatcctcaggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggttggtgttggcctttgaattcttgaaacactgcattcaagagtgaattcctttttgggggctgcctttagttttcaactttgtaagacttcattttgtatcagaaggataaagctttgcggtggttctgtaatagataaattcaacagaatcattatttgcatttaaaattctattcagtggtcgggcgaggtggctcacacctgtaatctcagcactttgggaggccgaggcgggtggatcatctaaggtcaggaattcaagaaaagcctggctaaaccccatctctacaaaaaatacaaaaattagctggttgaggtggctggcacctgtagtcccagctactcgggaggctgaggcaggagaatcacttgaacccgggaggcggaggttgcagtgagccgagatcatgccactgcactccagcctgggagacagaaagagactgtatcttaaaaaaaaaaaaaattatattcagtacagccataaaaagcaagaaacagccaggcgtggtggcttatgcctgtaatcccagcactttgggaggccaaggcaggcagatcacaaggtcaggagatcaagaccaccctggccaacatggtgaaagcccgtctctatttaaaatacaaaaattagccgggtgtggcgatgcacacctgtagtcccagctactcgggaggctgaggcaggaaaattgcttgaacctgggaggcggaggctgtagtgaaccgagtttgtgccactgcactccagcctgggtgacagagcgagactccatctcaaaaaaaaaaaaaaaaaagaacaagaaaaatgttcaagaaacaagaacaaggaacatgttcctttgcaggaacatggatggagctggaggccattatcctcagcaaactcatgcaggagcagaaaaccaagtaccagatgttctcacttagaagtgggagctaaatgatgagaacacatggacacacagaggaacaacacacactgggacctttcagagcatggaggtttaggcttataaccagggtgatgaaataatttgtacagtaaaccccatgacaagtttacctatgtaacaaacctgcacttgtatttctgaacttaaaagttaaaaatgtgtttttaaataaagcatgtaaggtcactaggaagcatcagatttgcaacgagatgaattcattatgcaaatggaaaaaaatttttaagaaatgaaataaaatgccattccaagggtctgtgtcagcactgtccccagaactttctgcaggggcaggaatgccttatggtccacactgtccagtgtggtagccactagccttgggggctactgagcacttcccatggctagtgtgactaggaactgagttttaattttttattttatgtttttttgagacagagtgttgctctgtcccccagtctgaacctcccaggttcaagcaattctgtctcagcctcccaggtagctgggactacaggcatgtgccatacacccccagctaactttcgtatttttagtagagatggagtttcaccatgttggccagtctggtctcgaactcctgacctcaagtgatctgcctgcctcagcctcccaaagtgctggaattacaggcgtgagccaccgcatctggctgagtttttaattttagttcatttaaatgtaagtagccacacatagctagtggccaccacacgcaagtggcgggtggcttttgggaaggtatgcttatccagagtaggacagcaacatagcatttgggtgaagataaagttacaaagccctgaccatcaagttccacccgtgtggaatgcaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtaaggaatgggacccttccccagggaaatctggcaggatgtggttttgaaactggattaagacagactgttctgttacctattttggcaggtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggtaggatctggacctgtggcttttagatggttggtgcaggggaaggggctgaacttttaagtgactaggatgttccacgtttgtggcaaacacttctgagagcataccttttgaaggattattgcaaactctggatgttttattcatttaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcaggtgggtgccttggccatgcagagactggcgggccccgcacagtagctccttggccgcacagaggctggcgggccctgcacagtagctccttggccacgcagaagttcagcggggtgccgagggagctgcctcaccgctgcccactgcttcctttcagatacacttcttgtaccagtactccctccagtttttcctggacatttatcacaacgtcctatacgagaacccgaacctgaagggtgtcaccgaccacacacagcgcctgtccattataacaaaggacctcttccaggtagagtgaggtcctcagccgctccctggcgggggggaagcagggtgctgcttctcttatggaacaacatcgtctcctgctcttgtcccaggtggcgtttaaccgagtggctcgaggcatgctgcatcaggaccacattacctttgccatgctgctggcaagaatcaaactgaagggcaccgtggggtaagagaactcacgcccacaggaggatgccatattgctggtggcccccaagggtttcatgatcagatacatgcttttattatttcttttattttctcttttattttctttattttattttttgagacggagtctccctttgttgcctaggctggagtgccgtggtgtaatctcacctcactgcaacctccacctcccaggttcaagcaattctcctgcttcagtctccgaagtagctaggactataggcgcaggccaccacatctggctaattttttttgtatttttagtagagacgggttttcttcatgttggcagcccagcctggtctcaaactcctgacctcaagtgatccgcccacctcggcctcccagagtgctgagattataggcctgagccactgtgcccggcctgttttctcttttcttaaatcacagctgttatcttagtgacagtgggagtgaacgtgagagaccctagctaacctgttgcacccttcgcagggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgaggtgattgttctcttgaatgttcccagtaggtaaatgttggccttttcccaggaaatgtaaggaattgcatgtggtataaaacccagaatgttgtgtctgcgctctcgcgtcagactctcgctcagtcgtgggttctgccccagaggccagccctgctccatgggtgcttccactattgtctccacagcaatttggcatctggctggacagcagctccccggagcagactgtgccctacctctggagtgaagaaacacctgcaagtaagccccactgtggttttctttctggacctgaatgtaaagttgggttttgctgcttaaagggatgctttcaaaaaacacaaagttactagcctgggcaacatagtaaggccccatctctacaaaaaataaaaccttagccaggcgtggcggtgcacacctgtagtcccatctactcgggaggctaaagcaggaaggtcacttgagcctgggaggtcgaggttgtgtgagctgtgattgcaccactgcactccagcctgggcagcagacagaggcctgtctgtgaatgaatggtcactgattcccaagataagtatttcaatgttaaaactttttaaggaaaccacttagggagatcgcttctaggtaggtgttggcttagaagtaaatcagaaatttccaattcctattcatctcatgcttaaagaccacaagagaactagatggggaactcctgcctaatgctaaggagttaactggctgtattcatgctgcagacaggaatggaatgccatcagccgtttttgagtgtgttaggccagaccctgggctagccaggctgagaggaagtgtcagactgtggagggcagagcgtggagcccccttcctgagtaccttcaggtgttctcaggaagtgagcaggtattagtttagtaatctaaaaatcagcaaatggcacctttgtcctatggatacatccaggtagtaaggtgttctcacaggcgtgtccagagggctcacggaaggcacagcagatgtggctgaatttcctgatttgagctgatcctgaaatgctgagcatttgctgagtgggtactttgggaagaacagtccaggcaggggagggcgtctctgagtccatgcttccacccagcacccacccctctgtacctgtttcagcacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtaatgtcctggtacagcccgggcttcccacgagactccatgcccacctccccagccacaggtggcagcagccctggcatctgctctcactccgggctacagtctcctcctaagaccaggaactcgctgcagattctcaactcctggctgcatggtgcccacacctctgggcccagaaagaacatcttctcaggcccctcactcggggctctcctttcccttgacaggtacacactatttgctggcactgtaataacttctgccttctttgtttgcaggtgaagcccaacactcctgtcttaatgtgctctgtgcctggttatgatgccagtggacatgtcgaggaccttgcagccgagcagaacacgcagatcacttcaattgcaatcggtaaggatgcttgaggggcttcatgggctggagccctgcaggatttgtggtgggcattgatgtccgaggctgccgctgctaacactaagtttccctgcaccaggctctgcagaaggctttaaccaagcagataaggcaataaacaccgctgtaaagtcgggcaggtaggcctgttctctttggctgaagaaagccttagtccccaggcattcaggcaggcagcctggcatgctgtgtgactctcactttgtgtgtgcaggtgggtgatgctgaagaatgtgcatctggccccagggtggctgatgcagctggagaagaagttgcattccctgcagccgcatgcctgcttccgactcttcctcaccatggagatcaaccccaaggtgggtggttgaaggagtggagacgttgcaggctggcctggcactgtgctgtcggcacgtgtgtggtggaattgaacaggcgccctcatccacacccgagcataactggaacggcgctctcccttaggtgcctgtgaatctgctccgtgcgggccgcatctttgtgttcgagccaccgccaggggtgaaggccaacatgctgaggacgttcagcagcattcccgtctcacggatatgcaaggtaagtaccttgtcctcctggtatgctttccccatagaagctaaagcccagtcccatcaccaaatgcagaagtgggtccctgggcccccggaagtgccgtgtggtgaactgcacagctgcttttgcttttcagctgtaggtaaaatttccttccatggccgggcaccgtggctcacactggtaatcctagcactttggaaggtcgaggtgggaggatcacttgagcccaggagttcaagactgtctgggcaggccaggagtggtggctcacgcctgtaatccctgcactttgggaggctgaggtgggcagatcacttgaggtcaggagttcaagaccagcatggccaacatggtgaaactccgtctctactaaaaatataaaaaattagccaggcgtggtggcgtgcgcctataatcccagctactggggaggctgaggcaggagaatcgcttgaacccaggaggcagaggttggcagtgagctgagatcacatcactgcactccagcctgggcgaaagagcaagaccccgtctcaaaaaaaaaaaaaaaaagacctgtctggacaacatagtgagatcctgtctctatataaaatttccttcctttgagcaggttgaaaagtaaaagccatgtttgattatggggtgtgatgaggtcccagaggagcagagatgcccacggagaagctgggactcagagttgtgtccccaggtggcaggcaatctcctctcccccagcacaggcccccaagaccaaacagagccctcccaggcgccaagtgaagaccgaaactcttgggcgagaggagggggattgtggcaggggtttcgttctgtcaattctgttctattttgtgccacattcacgttttctgacattcttagaaactctgtcttctctagatttcttactggctgaataaattctgatggtctcattggatgacacgtctattaatagaaaagttggcatacttttctcctagcagcagaactcatgtgaatctgctgccatcgtcaggatgtggagagctctttgtaaagctttgactgacctggcatctgcactgttcttggcgaagtgctgttttctaatgactctgtgcttggtcactttcctcaccagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaaggcaagtgtgggccatgccaggacagacagtggacgtgtatctgggaaggatgctgcagggcgtggtgctgagaggccagactctgcgtggaagagcgagctgacccctcgtgaccgccaaagcctagctggccatggggagtgaggaggaaagctgtgcccctcgaaaggaagccccgggcctgcccgcctctgaccacacacacgaaccctgcttttcctcccccagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggtatgctgctgcctgctggaatggagacagttgtgatgtcagggcgtctggtgtcactcagaggtgacccctgacatcatttccaaatgcactggttttctaggcgagaggagtttgtgcagtgggtggagttgctccccgacacccagacgccctcctggctgggcctgcccaacaacgccgagagagtcctccttaccacacagggtaggcaacaaggatcctccccacacgcagggtgggtggcgagggtcccctcacgcggggtgggtggcgagggtccccacacgcagggtgagtgtgcactgctgtcccagggccctccctggttatgctgggtgtggctctgtcagcctcggccttcctgccagtctccagctgctcctagctccactccgaggggaggcagaggaaagaactggctcttctctgcagcatcaactcagttctagagaaaaggcttgatatttatgtaaatgagcctagaaataacatttagatgttcatctcatattgaaaagcagttactggctgggcacactggctcacacctataatcccagcactttgggaggccaaggcgggcagatcactcgaggttaggatttccagaccagcctggtcaacatggcaaaacctcgtctctactaaaaatacaaaaattaggtgagcatggtggcaggcacctgtaatcccagctactcaggaggctgaggcaggagaattatttgaacccgggagatggaggttgcagtgagccgagatcacatcactctactctagcctgggcaacagagtgagactctgtctcaaaaaaaaaaaaaaaagccgggcgcagtggctcacgcctataatcccactataatcccagcactttgggaggctgaggtggatggatcacctgaggtcaggagttcgagaccagcctggccaacatggtgaaatcccatctctacaaaaaatacaaaaactagccaggtgtggtggtgggtgcctgtaatcccagctactctggaggctgaggcaggagaatctcttgaacccgggaggcagaggtttcagtgagctgagaacgcgccattgcactccagcttgggcaacagaacaagattctgtctcaaaaaagaaaaaagaaaatcagtttcttttttttttcttcaagagttgaaaagtacctgatattaagtgattttttaaaaccattcatcttccctagaattttttagcagtctttgtttccttttcacttacttacaagatgttttttaagacttcaagtgctgtgagccagaagggagctaagaaattctctaagccagtggctctcatagtgtggctcccaaaccagcagcagcagcagcctccccagaacttcttagaaatgcaggttcccagccgggcacggtggctcaagcctgtaatcccagcactttgggaggccgaggtgggcggatcacaaggtcaggagatggagaccatcctggctaacacggtgaaaccccgtctctactaaaaatacaaaaaaaattagccgggtgtggtggcgggcacctgtagtcccagctactcaagaggctgaggcaggagaatggcgtgaacccgggagggggagcttgcagtgagccgagatggcaccactgcactccagcctgggcgacagagcaagactttgtctcaaaaaaaaaaaaaaagaaatgcgggttcccaggccctgcccaggcgcactctatcaggacaggggatgggcccagcaactggccttcacaaagcctccaagcactacacgtggggttgacagcagctgatcaaatctcaactttttcttatgggaaaaagtcacgaaaagctaagaagacaagaaaagctaagaagacaagggcattgctgaaactcacagctggttaacaggacagaatcaggagggataagccaggcgagctgggcgggtctggagggaaagccaaagccaggcgagctgggcgggtctggagggaaagccaggcgagctgggcgggtctggagggagagccaggcgagctgggcgggtctggagcacactgcaggcaccacaaggctcggggtaatcccagccacatggtggcagtcacaggccaagggacactgtggtgaccagttttctgagttaagagggcaggtggcaccccctcctggagcgcctctcgagcacgcactcattcatggtcgggctgaaagccggccggggcttggcccaggtctcacagtgaacccaaacccagggtcctgaagagccttccttgagtctttggactcgggctgctggttccgtttttttttttttgctttgagactgagtcttgctctgtcactcagactggagtgcagtggtgcaatcagagctcactgcagcctcagctttctgggctcaagcgatccccccacctcagccttccaagtagctgggaccacaggtgccaccaccacacctgcctttctaattttttgtagagatgagggtctcactatgttgcccaggctagtcttgaacccctgagctctagagatgctcccgcttccgcctcccacagtgctgggactgtgggcgtgagccactgtggctgtcttgctggtgctgggactgtgggcgtgagccactgtggctgtcttgctgggtcagttttaacagtcatgttctcgacctggtaacaattcttattctgtatctgtctccttagctttctggtcaggccattgtctgtgctttaaaaacatacatgactggccaggcatggtggctcatgcctgtaatcccagcactttgggaggccaaggcgagcagatcacctgaggtcaggagttcaagaccagcctggccagcatggtgaaaccctgtctctactaaaaatacaagaaaaaattagccaggcgcggtgccacatgcctgtaatcccagctacttgggagcctgagtcaggagaatcacttgaacccaggaggcagaggttgcagtgagccaaggtcacgccactgcactccagtctgggtgacagagcgagactccatctcaaaaatatatatatacacacacacacacatatatatatacatacacatacgtatatatatatacacatatatgtatatatacacgtgtgtgtgtgtgtgtgtgtgtatatatatatatatatatatatgtacacacggctgagcaccttccagattttgctgcagttcccagtgtggactcactcaccatgtggcctttacgttcaagtcccttttccctctgtgatttcttgcccgtcccctccctccttcctgctgcgactgtgggactgtggcccaggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggtagctgggagggtggcgggccggccaggtctcaaggtcccaggtgctgggtatggtcatggaccattgttccatggaccattggttccactgtgccggacggaacgtactcacaccggtgtcacctcagagcaggtgtccagctgagcccaggcattgggcaagatgagttggcccttttgaaatggactgaaaacaccctagaagattgtgagataggcagacagcgccacagcgagcagccgcagcccttcctccctagagagccccgagagctgcgactcgggcaggggcctcagcgggtttctgagcagcctcagcttcacacaagctcggttccaagtcacgctctgccaaagctgtccgtgaccctggacagttcggaagctctggggctctccccggaggccgagttacttctgtttgacctttacactggagaaaggacctcttcctaacttctcttcacccttttgaacgattttaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaaggtgcgtgagaggccgaactcgtggtgtggcttccggcgggcaccttggccaggggccacaacccagcccagccacacagcaccacgtgcagacagccaggcctgcaggagcttccgagagcagctctgtgctcttaccctcaaggtgggcggggggaggggaggagcttagaaatgctgaagaatttgtttttcttctgtgctggttcactgaatgttgaccaaaatctttacacaacttctagttttttaggggtcttccaagacgacagtgaatggggaatgtggtggtccaggatggtgacagacggtagtaggttacggcctgtgaagaatgggtgtcccccaggacagtggaaaagcaggggcaggcgggcatggggggctcatccaaagttgtggggagcccccagcatcctcctgtttgccccaaaagccctaattgccaggaacactgagccacttgtgtgacatgaggttttagccgcggttttgcttggatgtgattatggtcctccagaaagacacacctggactaatttgaccctagaaactgcacggttctgagacatgctctggaccagcctgagctagagcagatgtggtgagggcggcgccaggggcataaagtgcagcctgggaaaggcagtaggtggagccgccagccgcctgtgtgggcagccaggatgcctagcacttgcacatttgttccatctgtgctgggggagttgtgagagctgacaccctgggctctgtgtgccttggctgcagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaaggtgaaggcgctcctgacgagtctcgggtggtcagcagctgtcctgggctggggtgggagtggctctggggaaaaacacagggcccaggtctgacctgagctccttcccctgggggctgctgctttccacagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtgagtggagtctcacagaaaatactggctctttgcaggtgacctcggtggcctgagaccattgttcccagatacatgcacttagggtgaccggctggcagttgggtggagcctctgggcgccctgtgactggggtttgtgtagctgttgtgttcacctcagcctgggttttggcttccgcctcacaggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaggaggcactgcctttcccaggcattctgcagggacccctgcggtaacaagggcagaggcggctcctcttctatgcctgggttccacttggaacgggaaatgaggttcacagaggaaatccatttcgcacctgtccaaacctctccttgccgggccccatcagctgtcccgggcagtcttccagttttcttacttttcccttaagccaccagtaaacccctctgcttctgcaggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatgagccggctccgcctcttctgtctccgctttcatcccagggcacagagccttgccttccatgctgcccagggagggcagcccacggcagccatgcccctccccacctcgctttcatcatgagctcgctcccgagcggcc

SEQ ID NO: 13407 - DNA, 10622 bp, Homo sapiens
ccacccccaggatccagggcctgactgtggagcaggcggaggcggtggtgaggctgagctgccttcccgcgtttaaggacttgattgcaaaggttcaggcagacgaggtgattgttctcttgaatgttcccagtaggtaaatgttggccttttcccaggaaatgtaaggaattgcatgtggtataaaacccagaatgttgtgtctgcgctctcgcgtcagactctcgctcagtcgtgggttctgccccagaggccagccctgctccatgggtgcttccactattgtctccacagcaatttggcatctggctggacagcagctccccggagcagactgtgccctacctctggagtgaagaaacacctgcaagtaagccccactgtggttttctttctggacctgaatgtaaagttgggttttgctgcttaaagggatgctttcaaaaaacacaaagttactagcctgggcaacatagtaaggccccatctctacaaaaaataaaaccttagccaggcgtggcggtgcacacctgtagtcccatctactcgggaggctaaagcaggaaggtcacttgagcctgggaggtcgaggttgtgtgagctgtgattgcaccactgcactccagcctgggcagcagacagaggcctgtctgtgaatgaatggtcactgattcccaagataagtatttcaatgttaaaactttttaaggaaaccacttagggagatcgcttctaggtaggtgttggcttagaagtaaatcagaaatttccaattcctattcatctcatgcttaaagaccacaagagaactagatggggaactcctgcctaatgctaaggagttaactggctgtattcatgctgcagacaggaatggaatgccatcagccgtttttgagtgtgttaggccagaccctgggctagccaggctgagaggaagtgtcagactgtggagggcagagcgtggagcccccttcctgagtaccttcaggtgttctcaggaagtgagcaggtattagtttagtaatctaaaaatcagcaaatggcacctttgtcctatggatacatccaggtagtaaggtgttctcacaggcgtgtccagagggctcacggaaggcacagcagatgtggctgaatttcctgatttgagctgatcctgaaatgctgagcatttgctgagtgggtactttgggaagaacagtccaggcaggggagggcgtctctgagtccatgcttccacccagcacccacccctctgtacctgtttcagcacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtaatgtcctggtacagcccgggcttcccacgagactccatgcccacctccccagccacaggtggcagcagccctggcatctgctctcactccgggctacagtctcctcctaagaccaggaactcgctgcagattctcaactcctggctgcatggtgcccacacctctgggcccagaaagaacatcttctcaggcccctcactcggggctctcctttcccttgacaggtacacactatttgctggcactgtaataacttctgccttctttgtttgcaggtgaagcccaacactcctgtcttaatgtgctctgtgcctggttatgatgccagtggacatgtcgaggaccttgcagccgagcagaacacgcagatcacttcaattgcaatcggtaaggatgcttgaggggcttcatgggctggagccctgcaggatttgtggtgggcattgatgtccgaggctgccgctgctaacactaagtttccctgcaccaggctctgcagaaggctttaaccaagcagataaggcaataaacaccgctgtaaagtcgggcaggtaggcctgttctctttggctgaagaaagccttagtccccaggcattcaggcaggcagcctggcatgctgtgtgactctcactttgtgtgtgcaggtgggtgatgctgaagaatgtgcatctggccccagggtggctgatgcagctggagaagaagttgcattccctgcagccgcatgcctgcttccgactcttcctcaccatggagatcaaccccaaggtgggtggttgaaggagtggagacgttgcaggctggcctggcactgtgctgtcggcacgtgtgtggtggaattgaacaggcgccctcatccacacccgagcataactggaacggcgctctcccttaggtgcctgtgaatctgctccgtgcgggccgcatctttgtgttcgagccaccgccaggggtgaaggccaacatgctgaggacgttcagcagcattcccgtctcacggatatgcaaggtaagtaccttgtcctcctggtatgctttccccatagaagctaaagcccagtcccatcaccaaatgcagaagtgggtccctgggcccccggaagtgccgtgtggtgaactgcacagctgcttttgcttttcagctgtaggtaaaatttccttccatggccgggcaccgtggctcacactggtaatcctagcactttggaaggtcgaggtgggaggatcacttgagcccaggagttcaagactgtctgggcaggccaggagtggtggctcacgcctgtaatccctgcactttgggaggctgaggtgggcagatcacttgaggtcaggagttcaagaccagcatggccaacatggtgaaactccgtctctactaaaaatataaaaaattagccaggcgtggtggcgtgcgcctataatcccagctactggggaggctgaggcaggagaatcgcttgaacccaggaggcagaggttggcagtgagctgagatcacatcactgcactccagcctgggcgaaagagcaagaccccgtctcaaaaaaaaaaaaaaaaagacctgtctggacaacatagtgagatcctgtctctatataaaatttccttcctttgagcaggttgaaaagtaaaagccatgtttgattatggggtgtgatgaggtcccagaggagcagagatgcccacggagaagctgggactcagagttgtgtccccaggtggcaggcaatctcctctcccccagcacaggcccccaagaccaaacagagccctcccaggcgccaagtgaagaccgaaactcttgggcgagaggagggggattgtggcaggggtttcgttctgtcaattctgttctattttgtgccacattcaccttttctgacattcttagaaactctgtcttctctagatttcttactggctgaataaattctgatggtctcattggatgacacgtctattaatagaaaagttggcatacttttctcctagcagcagtactcatgtgaatctgctgccatcgtcaggatgtggagagctctttgtaaagctttgactgacctggcatctgcactgttcttggcgaagtgctgttttctaatgactctgtgcttggtcactttcctcaccagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaaggcaagtgtgggccatgccaggacagacagtggacgtgtatctggggaggatgctgcagggcgtggtgctgagaggccagactctgcgtggaagagcgagctgacccctcgtgaccgccaaagcctagctggccatggggagtgaggaggaaagctgtgcccctcgaaaggaagccccgggcctgcccgcctctgaccacacacacgaaccctgcttttcctcccccagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggtatgctgctgcctgctggaatggagacagttgtgatgtcagggcgtctggtgtcactcagaggtgacccctgacatcatttccaaatgcactggttttctaggcgagaggagtttgtgcagtgggtggagttgctccccgacacccagacgccctcctggctgggcctgcccaacaacgccgagagagtcctccttaccacacagggtaggcaacaaggatcctccccacacgcagggtgggtggcgagggtcccctcacgcggggtgggtggcgagggtccccacacgcagggtgagtgtgcactgctgtcccagggccctccctggttatgctgggtgtggctctgtcagcctcggccttcctgccagtctccagctgctcctagctccactccgaggggaggcagaggaaagaactggctcttctctgcagcatcaactcagttctagagaaaaggcttgatatttatgtaaatgagcctagaaataacatttagatgttcatctcatattgaaaagcagttactggctgggcacactggctcacacctataatcccagcactttgggaggccaaggcgggcagatcactcgaggttaggatttccagaccagcctggtcaacatggcaaaacctcgtctctactaaaaatacaaaaattaggtgagcatggtggcaggcacctgtaatcccagctactcaggaggctgaggcaggagaattatttgaacccgggagatggaggttgcagtgagccgagatcacgtcactctactctagcctgggcaacagagtgagactctgtctcaaaaaaaaaaaaaaaagccgggcgcagtggctcacgcctataatcccactataatcccagcactttgggaggctgaggtggatggatcacctgaggtcaggagttcgagaccagcctggccaacatggtgaaatcccatctctacaaaaaatacaaaaactagccaggtgtggtggtgggtgcctgtaatcccagctactctggaggctgaggcaggagaatctcttgaacccgggaggcagaggtttcagtgagctgagaacgcgccattgcactccagcttgggcaacagaacaagattctgtctcaaaaaagaaaaaagaaaatcagtttcttttttttttcttcaagagttgaaaagtacctgatattaagtgattttttaaaaccattcatcttccctagaattttttagcagtctttgtttccttttcacttacttacaagatgttttttaagacttcaagtgctgtgagccagaagggagctaagaaattctctaagccagtggctctcatagtgtggctcccaaaccagcagcagcagcagcctccccagaacttcttagaaatgcaggttcccagccgggcacggtggctcaagcctgtaatcccagcactttgggaggccgaggtgggcggatcacaaggtcaggagatggagaccatcctggctaacacggtgaaaccccgtctctactaaaaatacaaaaaaaattagccgggtgtggtggcgggcacctgtagtcccagctactcaagaggctgaggcaggagaatggcgtgaacccgggagggggagcttgcagtgagccgagatggcaccactgcactccagcctgggcgacagagcaagactttgtctcaaaaaaaaaaaaaaagaaatgcgggttcccaggccctgcccaggcgcactctatcaggacaggggatgggcccagcaactggccttcacaaagcctccaagcactacacgtggggttgacagcagctgatcaaatctcaactttttcttatgggaaaaagtcacgaaaagctaagaagacaagaaaagctaagaagacaagggcattgctgaaactcacagctggttaacaggacagaatcaggagggataagccaggcgagctgggcgggtctggagggaaagccaaagccaggcgagctgggcgggtctggagggaaagccaggcgagctgggcgggtctggagggagagccaggcgagctgggcgggtctggagcacactgcaggcaccacaaggctcggggtaatcccagccacatggtggcagtcacaggccaagggacactgtggtgaccagttttctgagttaagagggcaggtggcaccccctcctggagcgcctctcgagcacgcactcattcatggtcgggctgaaagccggccggggcttggcccaggtctcacagtgaacccaaacccagggtcctgaagagccttccttgagtctttggactcgggctgctggttccgtttttttttttttgctttgagactgagtcttgctctgtcactcagactggagtgcagtggtgcaatcagagctcactgcagcctcagctttctgggctcaagcgatccccccacctcagccttccaagtagctgggaccacaggtgccaccaccacacctgcctttctaattttttgtagagatgagggtctcactatgttgcccaggctagtcttgaacccctgagctctagagatgctcccgcttccgcctcccacagtgctgggactgtgggcgtgagccactgtggctgtcttgctggtgctgggactgtgggcgtgagccactgtggctgtcttgctgggtcagttttaacagtcatgttctcgacctggtaacaattcttattctgtatctgtctccttagctttctggtcaggccattgtctgtgctttaaaaacatacatgactggccaggcatggtggctcatgcctgtaatcccagcactttgggaggccaaggcgagcagatcacctgaggtcaggagttcaagaccagcctggccagcatggtgaaaccctgtctctactaaaaatacaagaaaaaattagccaggcgcggtgccacatgcctgtaatcccagctacttgggagcctgagtcaggagaatcacttgaacccaggaggcagaggttgcagtgagccaaggtcacgccactgcactccagtctgggtgacagagcgagactccatctcaaaaatatatatatacacacacacacacatatatatatacatacacatacgtatatatatatacacatatatgtatatatacacgtgtgtgtgtgtgtgtgtatatatatatatatatatatatgtacacacggctgagcaccttccagattttgctgcagttcccagtgtggactcactcaccatgtggcctttacgttcaagtcccttttccctctgtgatttcttgcccgtcccctccctccttcctgctgcgactgtgggactgtggcccaggtgtggacatgatcagtaaaatgctgaagatgcagatgttggaggatgaggacgacctggcctacgcagagaccgagaagaagacgaggacagactccacgtccgacgggcgccctgcctggatgcggacactgcacaccaccgcgtccaactggctgcacctcatcccccagacgctgagccacctcaagcgcaccgtggagaatatcaaggtagctgggagggtggcgggccggccaggtctcaaggtcccaggtgctgggtatggtcatggaccattgttccatggaccattggttccactgtgccggacggaacgtactcacaccggtgtcacctcagagcaggtgtccagctgagcccaggcattgggcaagatgagttggcccttttgaaatggactgaaaacaccctagaagattgtgagataggcagacagcgccacagcgagcagccgcagcccttcctccctagagagccccgagagctgcgactcgggcaggggcctcagcgggtttctgagcagcctcagcttcacacaagctcggttccaagtcacactctgccaaagctgtccgtgaccctggacagttcggaagctctggggctctccccggaggccgagttacttctgtttgacctttacactggagaaaggacctcttcctaacttctcttcacccttttgaacgattttaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaaggtgcgtgagaggccgaactcgtggtgtggcttccggcgggcaccttggccaggggccacaacccagcccagccacacagcaccacgtgcagacagccaggcctgcaggagcttccgagagcagctctgtgctcttaccctcaaggtgggcggggggaggggaggggcttagaaatgctgaagaatttgtttttcttctgtgctggttcactgaatgttgaccaaaatctttacacaacttctagttttttaggggtcttccaagacgacagtgaatggggaatgtggtggtccaggatggtgacagacggtagtaggttacggcctgtgaagaatgggtgtcccccaggacagtggaaaagcaggggcaggcgggcatggggggctcatccaaagttgtggggagcccccagcatcctcctgtttgccccaaaagccctaattgccaggaacactgagccacttgtgtgacatgaggttttagccgcggttttgcttggatgtgattatggtcctccagaaagacacacctggactaatttgaccctagaaactgcacggttctgagacatgctctggaccagcctgagctagagcagatgtggtgagggcggcgccaggggcataaagtgcagcctgggaaaggcagtaggtggagccgccagccgcctgtgtgggcagccaggatgcctagcacttgcacatttgttccatctgtgctgggggagttgtgagagctgacaccctgggctctgtgtgccttggctgcagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaaggtgaaggcgctcctgacgagtctcgggtggtcagcagctgtcctgggctggggtgggagtggctctggggaaaaacacagggcccaggtctgacctgagctccttcccctgggggctgctgctttccacagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtgagtggagtctcacagaaaatactggctctttgcaggtgacctcggtggcctgagaccattgttcccagatacatgcacttagggtgaccggctggcagttgggtggagcctctgggcgccctgtgactggggtttgtgtagctgttgtgttcacctcagcctgggttttggcttccgcctcacaggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaggaggcactgcctttcccaggcattctgcagggacccctgcggtaacaagggcagaggcggctcctcttctatgcctgggttccacttggaacgggaaatgaggttcacagaggaaatccatttcgcacctgtccaaacctctccttgccgggccccatcagctgtcccgggcagtcttccagttttcttacttttcccttaagccaccagtaaacccctctgcttctgcaggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatgagccggctccgcctcttctgtctccgctttcatcccagggcacagagccttgccttccatgctgcccagggagggcagcccacggcagccatgcccctccccacctcgctttcatcatgagctcgctcccgagcggcc

SEQ ID NO: 13408 - DNA, 194 bp, Homo sapiens
aaccagtggcttcataaaaaaagatggcacaacttctgctattgcagactcttccagaatttagtgataagacattaaccgttttcttaactttgaatataaactcagatctttaaggattttttttgaggtagttaattgcctatggctaaaatcgtggtgatgtttcacctaatgctgggcactgtccagct

SEQ ID NO: 13409 - DNA, 439 bp, Homo sapiens
aaagtgctgagatgacaggcatgagccactgcacctggccaaatttttgtattttttgtagagatggaatctcgctattttccctgggctggtctcaaactcctggcattaagggctcctcctatctcagcctctcaaagtgccggggttctaggtgtgagtcaccgagttgagcccctaaacacatgtttttctttttagagacagggtctcactcggttgcccaggctggagtgcagtggcgtgaccatggctcactgcagcctcaacctcccgggctcaagtgatcctcccacctcagccttctgagcagctgggaccacagacacacaccaccatgtcggctaatttttgtatcttttgtagagacaaggtttcaccatgttgctcgggctggtctcgaactcctgagctcaagtggtcctcccaccttggcctc

SEQ ID NO: 13410 - DNA, 558 bp, Homo sapiens
gtctgccagtctcagggggctccatgggagtgaggaagggctcggcggccctgggggtctggtcctcctccgccatcctcgagtcctcgggctacgtgccctcatctttggcttccagggacacgggcccagctggccacttctatgacaagaatgtgggttttttgtgacagggcgtctactatatgaacttcctctggactctgacttcagtgtgtaggaagccaccttacagctcatgtcacccagagaacagtcgttgcagctccagttggaatgactgggggtgtcttccgaatcgccatcataaagatctaaaagctgaggacaaaagtgtttctcagtccaagagcagttctgcgaggcggaatcaagtctaacatgctcgcatgcgctgactcttcctcccgtcactgatgctggtttttgcaggctctgccttgcaaatgaatttttctttctttttttttttttttttgagacggaatcttgctctgtcgcccaagctggagtgcagtggcgcaatctgggctcactgcaacctccacctcccggatt

SEQ ID NO: 13411 - DNA, 2951 bp, Homo sapiens
ttctttttttttttttgtctgtcgcccaggctggaatgcagtggcgcggtctcggctcactgcaagctctgccacccacgttcacgccatttctccggccacagccttccgagtagctgggaatacaggtgcccaccaccactcccagctaatttttttgtatttttagtggagacggggtttcaccatagtagccgggatggtctcgatatcctgacctcgtgatccgcccgcctcagccttccaaggtgccatctaattttgatgttttaccttgtctccaattcagacacctgacacagctgcatcaagactatatatcactatatatatatatagtgtgactatatatcactatatatatcactagtgtgatatttcccctaaaattgtggaatagccaaacttttcctctgaggaaggattctgcttggataagcctgaaacctcaacctgagaccagaacaggggaattcatgcaactgcagattttgtgatgagtttccttttcattgatttaccacatcaacttatccattttagccacccatttatttgttcattaaagtatcatttttggccatctattcttggtgctgggttctaggtcctgggaatcaacagaaagcaagacagacatgatctctttctttacagttcttacattgtactgaggaagatatatgattaaaaaattacataaatcaggtgtggggatgatttatcttaaggtttaaataacattaaataacattgttaaaacttcataacaccaagaattaatgtagtcatatagaatttagctgtgaacaagactgtacatttctttcttataatagaacttcctgttaatgaatatgtcaaaacactttcatcactgacaacaaaattacaatggtaaggcacatcccataattaatacatagatttcatagatactattttaacatttacaaaaagtttcactgaattattttccataatttctatactatttttacattgatagtttttttttttagaaaagagaagatttgagttctcttatctgaagtttagaaggaattttgtaaatggaagatgaggatataattagcaattcaggggcttagaagtgtcttagaaaaaaatactaaaataatttacatcagatctcaacttcaaaaacagcttttctttaattcaaaagctggaagaaatgacgtttctaactgcgtatggaaaccgataatagcaatcaagaccatgatcatatttcctccctttattatcaaagagatttttttctaagctattcacatacttgctttaaatctagtattcttcagtactgtttatggtagacatatatgaaatttattctacctatacttgtcactcgaattctatagtgtgcattgtttacaataattctgtttgctttttactaaccataaaataggaattcataatggaataaaaccccaaagatacatccacattattggtttagaattgaatgaccttaccatccaataagatagaggttcaaacaatgatttctaagcacactgtggtatatttgtgtggttcaaataacaatagaaaacagcaatatctttcctgagataagctgttagttcttaataattataaatagacattgtaaattctacaaatgaaagataaaatacatgaatgaaatacacatggcttcataattctgaggaatttttgtcatattttgtataatctggcagttcatatgaaaaaaacaaaaaagagtatgttattgtcaatgttcttaagtttttcacacacacatacacacacacatacatacattttttagactaggttaaagatttatctaggtatatgtttggaaattattcatacacatacattacagaaaacactgtaagaaatataaaatgtttcatacaccaccagtttgttttctgctagaagacacacaatgcccctcttctgaatctatggagatgaaggcttctctcctttcactcagtacctcatttgccacaaaactgaaagataagtctgctttagcttcttgtttccccaaatcaggatgaacgggtgggctgaagaacagctgaatccaatagcttggcagaacatgaagacaggtttgttttccagattcttaaaactccaaactgatattattacagacacaaagtaaatggcacataacaagaagaaggagatcacagtttgcaaaacttttatgtggaccttggtactgggatcttgagatcctttgccatggagctgcatcttcttgagatgtttacacagagaacagactaacagcagaaaagatatcagggttacagtaaagggtactaagtttgctagcatggttacagtcgtatctgaaaggtacattgcacgcctcaatttgatcttccaagtcatgtttccttcatattcttttgtccatacaatctgattcatgtttaccacaaaaagatgacaagccaaaaatagcaaaggccccaacagcaccaccagaatgacactcttaactctcctctttaagcgaagaaaaataaggttggagaaattggcaatcttgagcaaataaaatatgctgaggctagtagcaggccagttgctgaaatggccggttactgcccagatattataagcagtagttcttaattctacactataaaaagctggattcaacacagttgaataccaatttaataataacacccagagcaaaccaactctggagaccgccagagcagtgacaatttggtcagcaaaggagatcttttgtctcttcacccactcggtggaatttaccaacgctatgaagccattagcaaaatttccaataacaaatgtaaccactactagaatggaaaatatgatgggcagaaaagttatcatgtctgaacagacaaaaagaaatttttaaaatgctggtgttgtatccg

SEQ ID NO: 13412 - DNA, 234 bp, Homo sapiens
taataacacccagagcaaaccaactctggagaccgccagagcagtgagaatttggtcaacaaaggagatcttttgtctcttgacccactcaatggaatttaccaatgctatgaagccattagcaaaatttccaataacaaatataaccactattagaatggaaaaaatgatgggcagaaaagttatcatgtctgaacagacaaaaagaaatttttaaaatgctggtgtaatatc

SEQ ID NO: 13413 - DNA, 235 bp, Homo sapiens
atactaatacccagagtaaaccaactctggagactgccagagcagtgagaatttggtcagcaaaagagatcttttgtctcttgaaccactcaatggaatttaccaatgctatgaagccattagcaaaatttccaatcacaaatgtaaccactattagaatggaaaaaatgatgggcagaaaagttatcatgtctgaacagacaaaaagaaatttttaaaatgctggtgtaatatc

SEQ ID NO: 13414 - DNA, 235 bp, Homo sapiens
ataataatacccagagcaaaccaactctggagaccgccagagcagtgagaatttggtcagcaaaggagatcttttgtctcttgaaccactcaatggaatttaccagtgctatgaagccattagcaaaatttccaataacaaatgtaaccactaccagactggaaaaaatgatgggtagaaaagttatcatgtctgaacagacaaaaaaaatttttttaaatgctggtgttgtgtc

SEQ ID NO: 13415 - DNA, 606 bp, Homo sapiens
cccaaccctttgatatatagtcttgcagtatcctgccatcactgagaaggctgactaccttgcccctgaacttggagtacaaccatttaacttgctttgataaacagaaaattactacactttgcatagagatttcagatggcttccataatggggattcttcctctttccatttaccatgagaatatcacctggctagtacactgttcccagaaggagagtgagaaactaatgaagtcagattgcccccacctgatccagaccaaattggccaaactctaactactaccaagattcagaatttggtccatttcaaataaacagagccatccaccaaacccagcttaaaaaaaatgaaatccaacaacatgtgagatataaacatctaatgtagtttggagggtttttctcttgcagaaaaacataactgataaatcaactctgctaaaccaagagtgtgggaaatatgtacaaccttgttgtgtcaggaattcaggagccaaaagcaaaaacagatgggaaattgcaaaggtttgttcttgtgaggtcgataattaaggctagaagaaatccattggaaagttctggggttggaggataacatca

SEQ ID NO: 13416 - DNA, 622 bp, Homo sapiens
atatatatatatatattttctagactgccattgggtcaaagacttttctaggtatacgtttggaaattattcatacacatacagtatagaaaaaccagtaagaaatataaaatgtttcatacaccaccagtttgtttcctgctagaagatacacaatgcccctctcgtgaatctatggagatgaagtcttctctcctttcacccagtacctcatttgccaaaaaactgaaagaaaagtctgctttagcttcttgtttccccaaatcaggatgaatgggtggattgaaggatagctgaatctaatagctttgcagaacatgaagacaggtttgttttccagacttccaaaactccaaactgatatcattatggacagaaagtaaatggcacataacaagaggaaggagatcacagtttgcaaagcttttatgtggaccttggtgctgggatcttgagatcctttaccatggagctgcatcttcttgagatgtttacacaaagaacagattaacagcataaaagatagtagggtcagagtgaagggtactaagtttgctaccatggttacagtcatatttgaaaagtacattgcactcttcaatttgatcttccaagtcatgtt

SEQ ID NO: 13417 - DNA, 3370 bp, Homo sapiens
gtttatgaattcagaaattctgctcccagcaagcagacctcactatgattctctatatttgcctgcttctcaaaatttggggttgcagtttgccctgcaacttcagctttccattggacttaagaaaagtcatggattttcagtttgttcagcattttttcttataaaaacaagagtgatgactctcaagctctttaaattttggaactgaaactagaagcaacaggacattctgacatgaattatttaaaagggtcattgttgactctagagacattttaatattgctgcatcaaaagataaaagcattctcctttcttcttgtgtgatatatgccgtgtacacctctgagctcaccactaacctcaactctaccttatccctaacttcccatttcaaatggaagggaatggggatcaaggagtagaaggcctgttttacccattattgatgattaaaaagctgaaaataacccatcacaaaatggcctcagtaaagtggctgcatcagacatcatttagcctggaaaaccagtatgcataaaggctcaaatttaaatttttgaatccagtgttttttatttattattatttttttttttctgagacggagtctggctctgtcacctaggctggagtgcagtggcacgatcttggctcactgcaagctccacctcctgggttcatgccattctcctgcctcagcctcccgagtagctgggactacaggcgcccgccaccatgcccggctaattttttgtatttttagtagagacagggtttcaccgtgttagcgaggatggtctcgatctcctaacctcatgatccacccgcctcggcctcccaaagtgctgggattacaggtatgagccactgcgcccggccctgaatccagtattttttaatagaaacatgagttggttgagatactgagttcctgccttctccatcctaatcccaaatttccaatctttggaaatttgcccctttaccatttaatctcctgagcccagctcctctccagcctgaagagtgtgtctgtcaagactgtagctgtgaacaaaacactattacttgagccttatcctggagcaaatgtgtgtggtctcaccaatgaacatcagataagtcccttggcatggatttcttttcctttttagtaatacaatcataaaggttattcagacttattgagcatttactatggccagaaattgtgatacttgctttccatatagtttatctcacttactcctattaccctttgaagtcagaattctaactatgaatcagagaaaataagtgacctgcctaaggtcatccagttggtttatggtgaaggcaggatgcaaactgaaatttgtctgtgatttgagttcggtgctttccctagtctcctcctctcagaggcagaacataagcatgtaatagataccactagggttcttgtttctaccttgggaacagctgtttgcaagtccaaattaggcagctaatctagcagttagcccagatacagcccttgggcaccctagtagctgtaacttccagaaggcaggaaccttccattcactagtgagtccccaaaacagtggcccaagtgaagcaaaaatgtttgttggaaatatgagtgaatgaaaaagtaatttcatgaacacatgaatgaataaatgaatgaagcaacacccagtatgatgattaatgccacaggaagatgcctttccaagcatcacaagatcctgggatcttcactgactgtaagtgcctgtggggcagggaccatgttggtcttattcatcactctcctgccaggtaaattagcacattcctggcacactgtaaatgttcaataagcttttgttcttttagatggattgacttatcagaggcaactctttcaagaacaagtagccctgtgctctggagaatgatttacagtggttctcttcctcagcctggggccttttctggataactcccatcgtactctcctctacttcctcttcctagaatacacaaatttattattacaggcaccactcttcaccccacatctgattcttccctgactctgcttaatgtacaagtaaagcaaagaaatactgtgtaggacctattggaattagaatcctgctctgtcaccattggaaaggatttagggatcacctccttcggaggtgagaataagaaagtgtcagtgagtaatccaatgtcacccagttgctcaccagacagaaagaccaagagttcacctctcctgcctattagtccagtgctcgggtggcccatgagttcatgttggccctgtcagaccaaagacagtaatgaatattaaacccagaatgcaccatattatcaggccttttttgtttttgttttctattagtaacacaggtagaagaggaaacaactaaaaccccaacattagaggctcaccatccccaccttctggcccaccactggcaatgaacccaagcacaggtcactgtggtctcatgaaagaaaactgatgtgggggttgggtgggcttcagggtgttgactgccatcttcccctccagcacctgaaaagctaagttatggtgtgaagtcagaaaatgtggaatctgcaagcctgtctttaaaaaacaaaaaaactcatagaacttggactttaatcataaagatcattttaccaaagcatattttttaaaggctgtgaaatattatgcaacgtttgcatggtttaattatgagtttagaaaagcctagcacgactttttcactacagtaaaacatgacggagcatgaatcatggcatagtactttatgcttagtgtggctttagacatggggttagaggtgtgaggctgtctacacaacaaggcgtgaattactgtactgcagttcacaccccggggggctttatgacagttctgaaacctcttttgtttgcttttaaaatgattaaagtattggagtactatatattcacttagtaaatgtgtgtatctagtatatacgcatgtcttatacaaaatatctaagtatatgatttttttttcacttggagcaaaatacttgcagtagcatggggatattgaaccgtctgctatttctgtttgcctttagtcattggaaacactgttagctgtaagattacacaggagcttcagccaaggttgaacatttattttctgctgagtttaaaatggaccagctccttttgttccttgccagctctttaaatcctctaaaatttggaataaaatgaagacctttctttaatattagatttcaaagattccaagttaaactatttgcctgggaactaccaggttttttaaacttaaaaaatcagttattttcactcacacacaaaaaagaaagaaa

SEQ ID NO: 13418 - DNA, 3370 bp, Homo sapiens; identical to SEQ ID NO: 13417

SEQ ID NO: 13419 - DNA, 3370 bp, Homo sapiens; identical to SEQ ID NO: 13417

SEQ ID NO: 13420 - DNA, 774 bp, Homo sapiens
gagggagggaggctgtcaggagaatactggggaggaagacttgggtctccaaatgtctgattctgttatccactgtggcagcttcaaagagataaacagaaaggcaaacttgaactgctggaaatgaaaagcccctggaggaagcagatctgaatattttataatgagcagaaatagctcatttctttatgtcctgacctatacaaaacttatacccagtattttcctaaagaagtctgctcttcctacactgctacctgcaggatcatgaagctctggctatgaagacccttgggagttacggtagttcactgttatctttgtccacaaagttgggacataaagagaaaattaatgtttaactccaaagaaatgtaaaactgtcttctagtgggacagtgtccaatttaagtttccttacacatttgcctaagaatagcgttggttttcctccccttttcatctgcaaacagtatgatgcttttgaaaattaagactcctttgaacgctggagtcaaattgacaaaatccactttgtctaaatcttttgaagtcagacttttgtctcttctctatcccaggcctcttataatggcaatctataaaatacctgctaaaaactctgacttttaaaagttgcaaactcgaagtcctgaaaaggaacagaaggcttgggttgatagggccagttctactgctgggtttgtgaactagtcattagacctcattgccggtttcccagccagaccttctttcctgtcatccttgggagag

SEQ ID NO: 13421 - DNA, 227 bp, Homo sapiens
agaccaacctagccaacatggtgaaaccctgtctctaccaaaaattacaaaaaaaaagaaaaaatagctgggcgtggtggcaggtgcctgtaatcccagctactcgggaggctgaggaggagaatcacttgaacccaggaggcggaggttgcagtaagccaagattgcgccactgcactccagtgtgggcgacagagcgagacactgtctcaaaaaaaaaaaaaaaa

SEQ ID NO: 13422 - DNA, 774 bp, Homo sapiens; identical to SEQ ID NO: 13420

SEQ ID NO: 13423 - DNA, 227 bp, Homo sapiens; identical to SEQ ID NO: 13421

SEQ ID NO: 13424 - DNA, 774 bp, Homo sapiens; identical to SEQ ID NO: 13420

SEQ ID NO: 13425 - DNA, 227 bp, Homo sapiens; identical to SEQ ID NO: 13421

SEQ ID NO: 13426 - DNA, 1557 bp, Homo sapiens
tgcgtttaacatttttatttttaactccgctttggtagtacaaaagtcataaaagtacaaaccagacagttaaaaatacacttgacactcgaaatggtgaaaattttccttacaaatttttacatcaaggtagtagccaactcattgatgacaccaaaaagttgtccatcattagtgttttctagagaaagtctgttgtggattccctcatccttagaaaggaggaggagtaacacaagacctgtaaacatcagttgctttgggaacacaggaattctcatcagatagttcagtataaaccagtaaaaagcgtatgtgttgaaaatactgaacgcttaattttggcaaatttggaagcctgccagacaaaaaccgctcaagtatttattagaaaatatttaaaacatactcttggtatcaatacagttttaaatatttttgagtattctcttgcctgttgtattgctatttaaaaaaaagtgctctgacttgaataagatggaaaaataattaaagctaaagaatatcttacattttatcccccaccattttgagggcatatttttaaagcaaaaaagtatgcttatttgtttttaattaaaatgattagcctagactgcacatatattatttacactaatacatacccctaaaagtcctatattgctactttctggatctcagtgaaatttatttccatactgactttctccagtccacagtgtatatgaatatgtacacatacagtgtttattagttgtcagtaaaaattctcatgaaactaaattccccatttatttaaaaggttagaaatgtttagtttgatgctggaaataaaatcattgaagtctatgtacagtaaatactttgaagtatatttttatggaaatcatcttttgggagacaaatgaaagatgtgcattttcctatatgaaataaaagaagtgctcaaggcaccccccaacactgacatggaggcgggtcttggagaccttgtaactggcctcccccacagctcaccccagagctaccataaatcatgtaatactatttatgcctctgggtcctttcaggtgttttgtaaaatgtacagttataaaaaaaaaaaagaaaaagaaaagtttgccaggcctaaagggaaaagtaactggagtgttttaaataatgagcattagttacaggatgaaaaacaggaaatacacaaagaaaaacatgccagaggtaggtgcaggcccatcttatatgagaagcagggttctaggccgggcgcagtggctcaagcctgtaatcccagaactttgggaggccgaggcgggtggatcacgaggtcaggagatcgagaccatcttcgctaatgcggtgaaaccccgtctctcctaaaaatacaaaaaaaataagccaagcgtggtggtgggcacctgtagtcccagctactcaggaggctgaggcaggagaatggcgtgaactcagaaggtggagcttgcagtgagctgagatcgtgccactgcactccagcctgggcgacagagcgagactccgcctcaaaaaaaaaaaaaa

SEQ ID NO: 13427 - DNA, 1568 bp, Homo sapiens
tgcgtttaacatttttatttttaactccgctttggtagtacaaaagtcataaaagtacaaaccagacagttaaaaatacacttgacactcgaaatggtgaaaattttccttacaaatttttacatcaaggtagtagccaactcattgatgacaccaaaaagttgtccatcattagtgttttctagagaaagtctgttgtggattccctcatccttagaaaggaggaggagtaacacaagacctgtaaacatcagttgctttgggaacacaggaattctcatcagatagttcagtataaaccagtaaaaagcgtatgtgttgaaaatactgaacgcttaattttggcaaatttggaagcctgccagacaaaaaccgctcaagtatttattagaaaatatttaaaacatactcttggtatcaatacagttttaaatatttttgagtattctcttgcctgttgtattgctatttaaaaaaaagtgctctgacttgaataagatggaaaaataattaaagctaaagaatatcttacattttatcccccaccattttgagggcatatttttaaagcaaaaaagtatgcttatttgtttttaattaaaatgattagcctagactgcacatatattatttacactaatacatacccctaaaagtcctatattgctactttctggatctcagtgaaatttatttccatactgactttctccagtccacagtgtatatgaatatgtacacatacagtgtttattagttgtcagtaaaaattctcatgaaactaaattccccatttatttaaaaggttagaaatgtttagtttgatgctggaaataaaatcattgaagtctatgtacagtaaatactttgaagtatatttttatggaaatcatcttttgggagacaaatgaaagatgtgcattttcctatatgaaataaaagaagtgctcaaggcaccccccaacactgacatggaggcgggtcttggagaccttgtaactggcctcccccacagctcaccccagagctaccataaatcatgtaatactatttatgcctctgggtcctttcaggtgttttgtaaaatgtacagttataaaaaaaaaaaagaaaaagaaaagtttgccaggcctaaagggaaaagtaactggagtgttttaaataatgagcattagttacaggatgaaaaacaggaaatacacaaagaaaaacatgccagaggtaggtgcaggcccatcttatatgagaagcagggttctaggccgggcgcagtggctcaagcctgtaatcccagaactttgggaggccgaggcgggtggatcacgaggtcaggagatcgagaccatcttcgctaatgcggtgaaaccccgtctctcctaaaaatacaaaaaaaataagccaagcgtggtggtgggcacctgtagtcccagctactcaggaggttgaggcaggagaatggcgtgaactcagaaggtggagcttgcagtgagctgagatcgtgccactgcactccagcctgggcgacagagcgagactccgcctcaaaaaaaaaaaaaaaaaaaaaaaaa

SEQ ID NO: 13428 - DNA, 528 bp, Homo sapiens
tccagcctaggggacacagcgagactctgcctcaaaaaaaaaaaaaaaaaaaccttctcaaaatgtgtaagtgctgtaggagtgacatggtggtggcaggagttaatgctgaatttgtggtcaaggaatccaaagtctagcatctggtcccatctgactccatggtcccttggggaatcaactcctcagggctaactagattatttccactgagcttttaccactgaagattcatcttttatcttttgtaacagctaacctgtatgtatcaagatcttcttacaaccagtgtcaaaataggatgcaggaactggaaaaagaaacacacactcacgtgcacacatgcatacacatatacacacacacccctgagcataagctcagactgtacatgaatagtatcactgcacatactcatcataatggaaaaactacagtgtgtacaccaaggcctgggattaggggctgggaagagtagaggctgggagtggttaagaagataaaaacagctctttccttccctggaag

SEQ ID NO: 13429 - DNA, 466 bp, Homo sapiens
cctactgctcagaaaaaaagattccattcaaaataataactcattgacaaggacctggtcagttacccaagagctcttatggagatgtacaaagggagaaatgctttcatgcctgctaacacaacatccattctgcagcccatagattaattcccactttcaagtctaattatttaagaaaggcatttcataaggctacagccgccgtagacagtgattcctctagtggacctcagtaaagtcaattgaaatcttctggaaggaattcaccattctagatgccattaagaacatttttgattcacaggaggtaaaaatagagacattaacaggagtctggaagttgattccaaccctcacagatgacttggaggggttcaagacttcagtggaggaagtcactgcagatgtggtggaaacagcagcagaactagaatcagaagtgagcatgaagattgaactgaat

SEQ ID NO: 13430 - DNA, 528 bp, Homo sapiens; identical to SEQ ID NO: 13428

SEQ ID NO: 13431 - DNA, 2636 bp, Homo sapiens
gtccctgggcagcatgctgtgtgccctgctcctcctgcccagcctcctgggggccaccagggccagccccacctcaggcccccaggagtgtgcaaagggctccacggtgtggtgtcaggatctgcagacagctgccaggtgcggggctgtggggtactgccaaggggccgtatggaacaaacccaccgcgaagtctctgccctgcgacgtatgccaggacatagcagccgccgctggcaatgggctgaaccctgacgccacggagtctgacatcctggctttggtgatgaagacctgtgagtggctccccagccaggagtcttcagccggatgcaagtggatggtggatgcccacagttcggccatcctgagcatgctccgtggggccccggacagtgccccggcacaggtgtgcacagcgctcagcctctgtgagccgctgcagaggcacctggccaccctgaggccactctccaaagaggacacctttgaggctgtggctccgttcatggccaatgggccccttaccttccacccccgccaggcgcctgaaggagctctgtgccaagactgtgtacggcaggtctcccgactccaggaggctgtccggtccaacttgaccttggccgacttgaacatccaggagcagtgtgagtccttggggcctggcctggccgtcctctgcaagaactacctcttccagttttttgtccctgctgaccaagcactgaggcttctccccccgcaggagctctgcaggaaggggggattctgtgaggagctaggggcacctgcccgtttgactcaagtagtggccatggacggggtcccctccctggagctggggttgccaaggaaacagagcgagatgcagatgaaggccggtgtgacctgtgaggtgtgcatgaacgtggtgcagaagctggaccactggctcatgtccaacagctctgagctcatgatcacccatgccctggagcgcgtgtgctcggtaatgcctgcctctatcacgaaggagtgcatcatcttggtggacacctacagcccctccttggtgcagcttgtggccaaaatcaccccagagaaggtgtgcaagttcatccgtctgtgtggcaaccggaggcgggcccgggcagtccatgatgcctatgccatcgtgccgtccccagagtgggacgcggagaaccagggcagcttctgcaatgggtgcaagaggctgctcacggtgtcctcccacaacctggagagcaagagcaccaagcgagacatcctggtggccttcaagggtggctgcagcatcctgccgctgccctatatgatccagtgcaagcacttcgtcacccagtacgagcccgtgctcattgagagtctcaaggacatgatggaccccgtggctgtgtgcaagaaggtgggggcctgccacggccccaggaccccactgctgggcaccgaccagtgtgccctgggcccaagcttctggtgcaggagccaggaggccgccaagctgtgcaacgctgtgcaacactgccagaagcatgtatggaaagagatgcacctccacgctggggaacacgcgtgaccgtggctgccagagacccagagcctgctagcgaggcccatgaggtgggtgccttccccatccccatttcacaaatgaaaaactgaagctctgaggagggaggctgggaaggagcagagctgaagttcaaaaccaagtattcctgatcccgaaagcctctctcttaacaacggtgccgcacagctttgcccttgaaagcatctctactggaccggaacacactcatgtgccccgctccctgacccagccaaggctgccctttcatctccaaggctgagatgttgccggtggtcccatgagagcctgcccatgggctcaggtgcccctttaccttctgctggatggacatctggctgtgagccaggctggggtcatggccggggtgagcggaggcaggggtggacggaggcttcgagggcccatcactagtagggtcattacctcttgccaacagccggggggtgggagtctgggtctcgctcaggccagagcttctcaacctggagtccctgggggtggctgccaaaggtgtgtatgacaagcacgtatccctggacatttccggggagaggtctggggctttggtcacattctccaagggctgctgggcttcggagcagtccccccccatgtctcagccactacagggtccctctctctccttgcaccccagaccctccgctgccctggtaatgagcagaaggaaagtcttggggtgtgctcaaagtcaggagagcaaaatatgccaggcaaaagctcccgggaaaagccggaggagtctggggtggccaccgggatgtggagcagcgagggcaaagacggtgaacacagccctccagctgtctgagcctcagttttctaatctgtagaatggggatgatcatacctgcctcacaagaatgttgagacaattcacagagacgttctggagcccctttcccccgagaccggcattcatgagtctgctgggaccagaaaacccatctcaggggcccagcggggcacccaggagagtctggcggtgcaagcgctgtataaaccacaagcgttctccaaa

SEQ ID NO: 13432 - DNA, 2643 bp, Homo sapiens
  misc_feature (800)..(800): n equals a,t,g, or c
  misc_feature (966)..(966): n equals a,t,g, or c
  misc_feature (1043)..(1043): n equals a,t,g, or c
  misc_feature (1572)..(1572): n equals a,t,g, or c
  misc_feature (2361)..(2361): n equals a,t,g, or c
  misc_feature (2369)..(2369): n equals a,t,g, or c
  misc_feature (2385)..(2385): n equals a,t,g, or c
  misc_feature (2573)..(2573): n equals a,t,g, or c
gtccctgggcagcatgctgtgtgccctgctcctcctgcccagcctcctgggggccaccagggccagccccacctcaggcccccaggagtgtgcaaagggctccacggtgtggtgtcaggatctgcagacagctgccaggtgcggggctgtggggtactgccaaggggccgtatggaacaaacccaccgcgaagtctctgccctgcgacgtatgccaggacatagcagccgccgctggcaatgggctgaaccctgacgccacggagtctgacatcctggctttggtgatgaagacctgtgagtggctccccagccaggagtcttcagccggatgcaagtggatggtggatgcccacagttcggccatcctgagcatgctccgtggggccccggacagtgccccggcacaggtgtgcacagcgctcagcctctgtgagccgctgcagaggcacctggccaccctgaggccactctccaaagaggacacctttgaggctgtggctccgttcatggccaatgggccccttaccttccacccccgccaggcgcctgaaggagctctgtgccaagactgtgtacggcaggtctcccgactccaggaggctgtccggtccaacttgaccttggccgacttgaacatccaggagcagtgtgagtccttggggcctggcctggccgtcctctgcaagaactacctcttccagttttttgtccctgctgaccaagcactgaggcttctccccccgcaggagctctgcaggaaggggggattctgtgaggagctaggggcacctgcccgtnttgactcaagtagtggccatggacggggtcccctccctggagctggggttgccaaggaaacagagcgagatgcagatgaaggccggtgtgacctgtgaggtgtgcatgaacgtggtgcagaagctggaccactggctcatgtccaacagctctgagctcatgatcnacccatgccctggagcgcgtgtgctcggtaatgcctgcctctatcacgaaggagtgcatcatcttggtggacacctnacagcccctccttggtgcagcttgtggccaaaatcaccccagagaaggtgtgcaagttcatccgtctgtgtggcaaccggaggcgggcccgggcagtccatgatgcctatgccatcgtgccgtccccagagtgggacgcggagaaccagggcagcttctgcaatgggtgcaagaggctgctcacggtgtcctcccacaacttggagagcaagagcaccaagcgagacatcctggtggccttcaagggtggctgcagcatcctgccgctgccctatatgatccagtgcaagcacttcgtcacccagtacgagcccgtgctcattgagagtctcaaggacatgatggaccccgtggctgtgtgcaagaaggtgggggcctgccacggccccaggaccccactgctgggcaccgaccagtgtgccctgggcccaagcttctggtgcaggagccaggaggccgccaagctgtgcaacgctgtgcaacactgccagaagcatgtatggaaagagatgcacctccacgctggggnaacacgcgtgaccgtggctgccagagacccagagcctgctagcgaggcccatgaggtgggtgctttccccatccccatttcacaaatgaaaaactgaagctctgaggagggaggctgggaaggagcagagctgaagttcaaaaccaagtattcctgatcccgaaagcctctctcttaacaacggtgccgcacagctttgcccttgaaagcatctctactggaccggaacacactcatgtgccccgctccctgacccagccaaggctgccctctcatctccaaggctgagatgttgccggtggtcccatgagagcctgcccatgggctcaggtgcccctttaccttctgctggatggacatctggctgtgagccaggctggggtcatggccggggtgagcggaggcaggggtggacggaggcttcgagggcccatcactagtagggtcattacctcttgccaacagccgggggtgggagtctgggtctcgctcaggccagagcttctcaacctggagtccctgggggtggctgccaaaggtgtgtatgacaagcacgtatccctggacatttccggggagaggtctggggctttggtcacattctccaagggctgctgggcttcggagcagtccccccccatgtctcagccactacagggtccctctctctccttgcaccccagaccctccgctgccctggtaatgagcagaaggaaagtcttggggtgtgctcaaagtcaggagagcaaaatatgccaggcaaaagctcccgggaaaagccggaggagntctggggntggccaccgggatgtnggagcagcgagggcaaagacggtgaacacagccctccagctgtctgagcctcagttttctaatctgtagaatggggatgatcatacctgcctcacaagaatgttgagacaattcacagagacgttctggagcccctttcccccgagaccggcattcatgagtctgctgggaccagaaaacccatctcnaggggcccagcggggcacccaggagagtctggcggtgcaagcgctgtataaaccacaagcgttctccaaa

SEQ ID NO: 13433 - DNA, 3869 bp, Homo sapiens
ggcggcgggggcgaggtgagatgttggcagtggaaaggggttcgggctcggggggcggggggacgcggagcgatggcccgcgcggccgcaggggcggataaaaagccgtcgcgctgcgggagtgggcgggagggagaggggttgtccgagggccacaagagtatgacggggctgtacgagctggtgtggcgggtgctgcacgcgctgctctgtctgcaccgcacgctcacctcctggctccgcgttcggttcggcacctggaactggatctggcggcgctgctgccgagccgcctctgccgcggtcctagcgccgctcggcttcacgctccgcaagcccccggcagtcggcaggaaccgccgtcaccaccggcacccgcgcggggggtcgtgcctggcagccgcacaccaccggatgcgctggcgcgcggacggtcgttccttggagaagctgcctgtgcatatgggcctggtgatcaccgaggtggagcaggaacccagcttctcggacatcgcgagcctcgtggtgtggtgtatggccgtgggcatctcctacattagcgtctacgaccaccaaggtattttcaaaagaaataattccagattgatggatgaaattttaaaacaacagcaagaacttctgggcctagattgttcaaaatactcaccagaatttgcaaatagtaatgacaaagacgatcaagttttaaattgccatttggcagtgaaggtgctgtctccggaagatggaaaagcagatattgtaagagctgctcaggacttttgccagttagtggcccagaagcaaaagagacccacagatttggatgtagatacgttaggcagtttacttagttcaaatggttgtcctgatcctgatttagtattgaagttcggtcctgtggacagcacattaggctttcttccctggcacatcagattgactgagattgtctctttgccttcccacctaaacatcagttatgaggactttttctctgcccttcgtcaatatgcagcctgtgaacagcgtctgggaaagtagtggtcattggttgcgtaatttgatttgaggcttgtggaggaaaggacccaagtgactctgatgtttacaaagcacctatgaaaccctgtacacacctggttcataatcctcataatttatcaacaaacacaaaaaagtgtcttacttgagagtgagtgtgtgtgtgtgggtgtgcacgtgcacacatgtgcacgtttgtatgcatggaaataaacttataaatggggacgtattggagaaggaaatacatagacctacaactttgagcaaatagcagtgatgttttaggaactgaaatgtcacacttaaagtcttcagcccagctacttccctatttttgtggggagaagagggcctgattagaactgttctggttgtgtttggcgggaggggaataatttttgttcagtccttcttagtgaccaaactttaatttttaagaataatatattgacttactgaactgaagcattctgagttgaaaggagctccagaggagtggagttctgtgttgctcacatgttaaaatcttgctcaccttcagagcagagggaatacctatcttcagatatccgtccattttcatctcttaattgtagtcaaaagtatgacttgagagtgttgctctggtattctgggttctgaagtctggtattctggtattctgggttcaaaagtatgacttgagagtgttgctctggtattctgagagttgctctgtattctgggttctgaagattatttgaaaaataactcctactacattgaaatgcagacttttaaaaatttaaacattggattaggcagtcaaaaaaaccaagcaagcataaaaggtcaataagttgtaatcttgatagtaaaggtggaaaacttattataaatggaaagaaagttttggtttccttttttgtttgatgggcagtatgccatattatacccaaagttcttttaaaaaatatttccatcaaccatttttatttaaaataaacatttgagggaagttaccaaggcagcttttttcctcaaaagtaacctgttcctctttggaatagcacattttaggggcatggttaatacctgagatttttactcagtaaatcctgatggttactgtgtgtaaaatatctttaagtaggattgaaggcctctgtggggaaataaaatattaccaaagtctataaaaataaattttacatgttctcttttatgacagagagcagcactggttctgttatttttaaaatgaataattgatttcttgataggtgtttaatatttcttccctcactgctgattcttagatagaaaccattctttatatttgatagactgttttcagaaaacccttatcaacaagtgtacaatacttatctaaaactatacatttagaatggagcagtttaatactagatctcagaagttttgaaaaatagcaaagaagactggatttggaaagcatggtctacaattggttgttaaattctgaagctatgaagaataaatgtttcaactttggattatgaaaccccatttatgattttttaaatacacttgaaataaaaatgattaaactaaattttggtccagtgacattactttgcactgcataatccattatacattgtacgactttttttttttgttttaatttattactgagagttttgtgtgaagctacagcatatctaatcagagaatttctgattccttatactgtgattatattatattgaggcatttgtagtgccgctgaagactgaatttatgccttttgtaaacatgataggtataaatgtcttataaacattctggagtatgtatagctttaatgaatgaaatttaatggacctgattaaaatgaagggatttaatcgttgttaaagttaagttagtcaaataaattacctactggaatatagcccaagccagtaaaggtttattatttgcattttcatgcttttattttctccttccattcataagtatatacttgaaagtacatctgtagcctatgatttgagtctattgaagttctaggaagaggcaaactacaaactactaggattctgatttcagatgtagtcattccagaaccttctctttatgagttcacctgctagtacaatctccacaacttgaatggcattggttgttctataattcctgccacaagcatcacaagttgtacatcatcaaggctccctttgcactcccaagaagaactggtaattttaaacaaaagtatgtgtctttatttgtattggaaaatactgtctttaaattgtttcttgttgacactccccacaatggaaaaattaccgaattaaacctgttttatggatggcagcttggagcatagcaagaagttggaggatttgaattccattcccagttctcattgtgttttgtttcttaaaactataataatcggttactgttataaagtttaaaaggtggttttaatgtgaatagcaaattctggtatatcgtgactaacgcttaagaatgcctgtctttgagaggaaggtgttataatattaatgaacagtgccaaatacactgtgcatatctgcaatttaatctttgaatgtatgttactggattagctccctcctcctgtgtgatggtaccatgcatagagtcaatcaaatccttgtgatgttttgtatggactttgacaacatgtaaataatgtgtaaagccagtttttatgattaaggaatcaaatttattgaattttattattgaaagttgaaacttaacatgtatgaacaaaaaccaataaaagaatatactcttttcattgaaaaaaaaaaaaaatagaa

SEQ ID NO: 13434 - DNA, 7251 bp, Homo sapiens
taggtgctccatgaacacggaagatggcgccaagctctacgacgtctgcccgcacgtcagcgactcggtagtgtgctccatccaggccagcacccttctctgattgctcagtcctctggaaggaggacttcgtagcaaagacctggacccagctaaacagagcggtttcctagaaaaggggcgggtgcgcgccagagggtctaaaagtttgggtataggcagaaagtattagaacttttttttttttttttttttttgagacagagtctcactgtcgcccaggctggagtgcaacggtgcgatctcggctcactgcaacctccacctcccgggttcaagtgattctttggcctcagcctcccgagtagctgggattacaggcgtgtgccaccacacccgtctaatttttgtatttttagtggagatgaggtttcaccatgttggccaggctggtctcgaactcttgacctcgggtgatctgcccacagcctcccaaagtgctgggattacaggcgtgagccaccgcgcccggcagtattagaacttttatttgcatttttggtagcttttttttctcatcctttaaggttccactttgtctctctcagtacaggatgatgtgttagttacaatagtacatggacacacacagcaaacaagtagatatacagggggtgcgtgagcaaacaggtttcaggaccactgctctctggagtcttattcctcagagtatgagcccttgaccaaggagcatggaatgcatcacctatgtttgaacaagggcgccagatgacctctgcggacccagggtttgggaagtgctgatgtggagccacaggacttgttttagggcgtgtggggcgtgtgtgtgagtgggcttctgcaggtgggcagccagcgggcacaggcgtggagagcatggtcacccatggagacaccgctcacggggactttcctttggccccacatcccgcagggtctcttcttcgatgattcctatggcttctacccaggccaggtgctcattggccctgccaagatcttctccagcgtccagtggctgtcaggtgtcaagcccgtgctcagcaccaagagcaagttccgagtggtggtggaagaggtgggtccgggcccaagggtaggagatggagtccttgacctccacaccctggagctgagctgctgcccctttccttcctgctcttgagggttgagccccgctcctcagcatctggaccctgttgatctcaaagggctttggggataaagggaacccaggctctggtcatagtgaccaaaagacagatgtgccccagcccagcctgtacaggctgagcaaggtgggagggtggcaagtggcagttccagtggcccctggctggtatgagcagtgacactggtcctgggcattgggtgggggccgtggttacagttggggcctgctctgatgtgtctgtacttggtgctgcactaggaagatcagtttcctgctctggaggtcaagtgggctttgggcagctggctaaagagagtgctgtcagagcctgccctgactggcgtgtcccacctgccatccccaggtgcaggttgtagagttgaaagttacatggattaccaagagtttctgtccagggggcacggacagcgtcagccccccaccctctgtcatcacccaggaaaacctaggcaggtaagcatgcccttactgccagcaacccaggggcatgcgtgggacagggctctgggccctggtcacatgcctggggaggcttaagaacactgctggcctcccaggagtccagcccagctcacccccacttcttccccaaccagggtgaagcgtctcggatgctttgaccatgctcagcggcagcttggggagcgctgtctgtatgtcttcccagccaaggtagagccagccaagattgcctgggaatgtccagaaaaaaactgcgcccagggggagggctctatggccaagaaggtatgtccttggggttggggattggtgggcatttgaggaactggccttgagccatttccatggccaagaaggacagtctgtgctttaggccttggggggcagccctgatgacccttgccggctactcaggtgtatacagctgtcatccccccagcctgagatgcctagggccaggcctgcccaggtgcacctcacagccctgtcctctctgctccgcccttgcaggtgaagcgcctgttgaagaagcaggttgtgcggatcatgtcatgctccccagacacccagtgttcccgggaccattccatggaagacccagacaagaagggggaatccaaaaccaagagcgaagcggagtctgccagccctgaggagacgcccgatggctctgccagtccagtggagatgcaggacgagggtgcagaggagccccacgaggcaggagagcagctgcccccattcctgctaaaagaaggcagagatgacaggctgcactcggcagagcaggacgcagatgatgaggctgctgatgacacggacgacaccagttcggtgacctcctctgccagctccaccacttcctcccagagcggcagcggcacgagtcgcaaaaagagcatccccttgtccatcaagaacttaaagcgcaaacacaagaggaagaagaataaaatcactcgagacttcaagccaggggacaggtaaactcagagttgtgcccctccccaatggcgtcagcgtgaagccaggcagagtgcgcgtcccctcggtgtgcgtgcctgcgctcgcacacacacctctgcatgccttgtagtggctccggggctcccacccgagacaacgtaggtgcctggggtaggccctggtggaaagcagagactgaggagtggtgcagagggtgggatggtggtggccttaagcttggccttctggaaccacatttgcctgagctctcccaagtggatcctgttctcagagaatgcgtggccttggaaccctgggtgagcttcctgtgcaccagagactcatcctgccaacctgggattcagagtttcaggttaccaagcccacagggacaggaagggacagaaagactctctgccctttccgcggagggggtggggtttgcatggcctgctgactggcctgcacccgcagggtggcagtggaggtggtgaccacgatgacctcagccgacgtgatgtggcaggatggctccgtggaatgcaacatccgctccaacgacctcttccctgtgcaccacctggacaacaacgagttctgccctggagacttcgtggtagataagcgaggtagtgccagctctggaagggcagccagcagggtggtcgccaatgagggcccgggttggggcttgtggagaatgggcagtggatctggggtcagagctaaaatgaggtccagaaggggactgccctcatgaaggggtctcaccacttccaagacgggggaaggtcagggttctgcactctgcactggcttgagatgtgggctccttagccgggatcccttagctagtcacttccctttctctggttccctagtccagagctgtccagaccctgctgtctacggtgtggtacagtctggggaccacatcggccgtacctgcatggtgaagtggttcaagctgaggccgagtggggacgacgtggaggtgtgtgcagcccctactgcttgcttcaggtgggctctggggttgggtgtaggacccctagctcatgacaacctgtcctgtgccacagctgattggagaagaggaagatgtgagtgtttacgacattgctgaccaccctgactttaggttccgtacaactgacatcgtcatccgcatcggcaatactgaggatggggctcctcacaaggaggatgaggtacgccttcaaattcaagttctggatggctgctcactgccctgtgcaccagctgcagtccctgatgctgccaccaggtggctctaggagacaagacctgaaagtcctctgggctcagtgtcctcagaagggcagctgccccagagtcaagctgccgctcagcactagcagctgcagaaggacttgtttccctgcctcccttctggggtcaggcttcttgagctgccgctggttacatttaccagaggagctaagttccttgtcacaagccaggtgggcatgatgtcagtcactgcagagcacaggaggggctggggagctggagcttgagctgggccccctgactttgtcccctttgcccagcagccatcggtgggccaggtggcccgtgtggacgtcagcagcaaggtggaggtggtgtgggctgacaactcaaagaccatcatcctgccccaggtgaggctctggcaagacccccctgctgagcttgtgactatggcaacttgggccgggggccacaggcgtgtagccagaagatgggctctcaggtcttcctggtgagatctcagcgaaagcgtgaggggaaaggcaggcattccacacagcccttggtgcaggcctgcagttggcccaccagcctcgcttctcccagcaatctcttcacgtccatctctgggtgcatgtagactttcacaaacctccaggattttcctggattgtcagctcactatgctacgaagaatgcaagttccctcctaaaaggagatggagactttcctaccaccctttttagaaagctctaacagagaaggagagaaaggagagagccgacccagttctagccccacctgctgggtcctgagcagaagggctacacgggctctccttccctcgcctcctggttggagccacacagcccagctctcctctcctggtccacacagggggcaggagtgggggcgggaatggcttgccccatcaccttaacggccattccagggaacgcagcaggatatgtcggcccttctacatgtcccctcttgtcatatgttcccagctccccacacaggcctccttggctgcatcattagctgaccctgcgcttttcaggtgtgggactgggcctgccaaggtcccctaacgccttggacagatgctgacgaagtgcacagagcaggaggagaggctggaacagaccactggctggggctttgggtccagctggagggtgggacaggtgaagggcctctcccagagacctagggactgcaaaagccagagcagaggtcagggaaagggtggaatgaggttgccaaggcctcatgagcccagtcgccatcagctgtgcggatcagggatccccagagctcctccttagtggtggggaggtgacttcctgtctgcttaccctggcacttcccttctgcccccagcacttgtacaacatagagtctgagattgaggagtcagactacgattcggtagaaggcagcaccagcggggcatcctcggatgaatgggaagatgatagtgacagctgggagacggacaatgggctggtggaggacgagcaccccaagatagaggagccccccatcccacccctggagcagccggtggcccctgaggacaagggagtggtgatcagtgaagaggcagccacagctgccgtccagggggctgtggccatggctgcccccatggccgggctgatggagaaggctggcaaggacgggccacccaagagcttccgggagttgaaagaggccatcaagatcctggagagcctcaagaacatgactgtggagcagctgctgacgggctcgcccacctctccgactgtggagcctgagaagccaactcgggagaagaagtttctggatgacatcaagaagctacaggaaaacctcaagaagaccctggacaatgtggccattgtagaggaggagaagatggaagcagtgcccgacgtagagcgcaaggaggacaagcccgaggggcagtcacctgtgaaggctgagtggcccagcgaaaccccggtgctgtgccagcagtgtggcggcaagcctggcgtcaccttcaccagcgccaagggcgaggtcttctccgtactggagtttgcaccctgtgagtcagcccttgcctggtcttcgccttcccccgccttctcggggctcctgtttgtgtcaccagatctgggtgcagggtggttagtcccctcgccagaccccagctactgccccagggcaaaccatttccctgtgtggtcacagtgctgaggccagcagcggcgagtgggaagtctgtgggtgtgctcacctgtccagccaggttggcagatggagctccagggcctctccatgagggactgactattctcttcccccctctagcaaatcattcttttaagaaaattgagttccagcctccagaagccaagaagttcttcagcacagtgcggaaggagatggcgctgctggctacctcactgcctgagggcatcatggtcaagacttttgaagatagaatggcaagtaggcttggcatgggcaggtgcagatgtgctgtgtgggcacccagtgcccaagaggccaccaaccttgggtccccaaacctccggggctgactggcacctgcgaggacactcacccacccaccttttacaggggcggtcacaggctcagtcaggtgagggctgactcagccgtgtgtccaggccagatggttctttctttcctccctcctttaaaaaattactttctcggccgggcgcagtggctcacacccgtaatcccagcactttgggaggccgaggtgggtggatcacgaggtcaggagatcgagaccatcctggctaacacagtgaaaccccgtctccactaaaaaaaaaaaaaaaattacaaaaaactctcccgccaccatgcgggcgcctgtagtcccagctactctggaggctgaggcaggagaatggcgtgaacctgggaggtggagcttgcagtgagccgagatcacgccactgcactccagcctgggtgacagagcgagattctgtctcaaaaaaaaaaattactttgaaataggccgggtgcggtggctcacgactgtaatcccagcacttcgggaagccgaggcaggtggatcacctgaggtcagaagtttgagaccagcctgaccaacccggtgaaaccctgtctctacttaaaaatacaaaaattagccggatgtggtggcgggtgccagtaatcccagctactcgggagactgaggcaggagaatcacttgaacctgggaggcagaggttgtagtgagccaagatcgcaccattgcactccagcctgggcaacagagcgagacttcatctcaaaaaaaaaaaaa

SEQ ID NO: 13435 - DNA, 6251 bp, Homo sapiens
  misc_feature (1763)..(1763): n equals a,t,g, or c
  misc_feature (4551)..(4551): n equals a,t,g, or c
  misc_feature (4553)..(4553): n equals a,t,g, or c
cttcgatgattcctatggcttctacccaggccaggtgctcattggccctgccaagatcttctccagcgtccagtggctgtcaggtgtcaagcccgtgctcagcaccaagagcaagttccgagtggtggtggaagaggtgggtccgggcccaagggtaggagatggagtccttgacctccacaccctggagctgagctgctgcccctttccttcctgctcttgagggttgagccccgctcctcagcatctggaccctgttgatctcaaagggctttggggataaagggaacccaggctctggtcatagtgaccaaaagacagatgtgccccagcccagcctgtacaggctgagcaaggtgggagggtggcaagtggcagttccagtggcccctggctggtatgagcagtgacactggtcctgggcattgggtgggggccgtggttacagttggggcctgctctgatgtgtctgtacttggtgctgcactaggaagatcagtttcctgctctggaggtcaagtgggctttgggcagctggctaaagagagtgctgtcagagcctgccctgactggcgtgtcccacctgccatccccaggtgcaggttgtagagttgaaagttacatggattaccaagagtttctgtccagggggcacggacagcgtcagccccccaccctctgtcatcacccaggaaaacctaggcaggtaagcatgcccttactgccagcaacccaggggcacgcgtgggacagggctctgggccctggtcacatgcctggggaggcttaagaacactgctggcctcccaggagtccagcccagctcacccccacttcttccccaaccagggtgaagcgtctcggatgctttgaccatgctcagcggcagcttggggagcgctgtctgtatgtcttcccagccaaggtagagccagccaagattgcctgggaatgtccagaaaaaaactgcgcccagggggagggctctatggccaagaaggtatgtccttggggttggggattggtgggcatttgaggaactggccttgagccatttccatggccaagaaggacagtctgtgctttaggccttggggggcagccctgatgacccttgccggctactcaggtgtatacagctgtcatccccccagcctgagatgcctagggccaggcctgcccaggtgcacctcacagccctgtcctctctgctccgcccttgcaggtgaagcgcctgttgaagaagcaggttgtgcggatcatgtcatgctccccagacacccagtgttcccgggaccattccatggaagacccagacaagaagggggaatccaaaaccaagagcgaagcggagtctgccagccctgaggagacgcccgatgctctgccagtccagtggagatgcaggacgagggtgcagaggagccccacgaggcaggagagcagctgcccccattcctgctaaaagaaggcagagatgacaggctgcactcggcagagcaggacgcagatgatgaggctgctgatgacacggacgacaccagttcggtgacctcctctgccagctccaccacttcctcccagagcggcagcggcacgagtcgcaaaaagagcatccccttgtccatcaagaacttaaagcgcaaacacaagaggaagaagaataaaatcactcgagacttcaagccaggggacaggtaaactcagagttgtgcccctccccaatggcgtcagcgtgaagccaggcagagtgcgcgtccccnatcgtgcgtgcctgcgctcgcacacacacctcggcatgccttgtagtggctccgggctcccacccgagacaacgtaggtgcctggggtaggccctggtggaaagcagagactgaggagtggtgcagagggtgggatggtggtggccttaagcttggccttctggaaccacatttgcctgagcgtctcccaagtggatcctgttctcagagaatgcgtggccttggaaccctgggtgagcttcctgtgcaccagagactcatcctgccaacctgggattcagagtttcaggttacgcaaggccacagggacaggaagggacagaaagactctctgccctttccgcggagggggtggggtttgcatggcctgctgactaggacctggccgcagggtggcagtggaggtggtgaccacgatgacctcagccgacgtgatgtggcaggatggctccgtggaatgcaacatccgctccaacgacctcttccctggcaccacctgacaacaacgagttctgccctggagacttcgtggtagataagcgaggtagtgccagctctggaagggcagccagcagggtggtcgccaatgagggcccgggttgcggcttgtggagaatgggcagtggatctgggtcagagctaaaatgaggtccagaagggactgccctcatgaagggtctcaccacttccaagacgggggaaggtcagggttctgcactctgcactggcttgagatgtggctccttagccgggatcccttagctagtcacttccctttctctgttccctagtccagagctgtccagaccctgctgtctacggtgtggtacagtctggggaccacatcggccgtacctgcatggtgaagtggttcaagctgaggccgagtggggacgacgtggaggtgtgtgcagcccctactgcttgcttcaggtgggctctggggttgggtgtaggaccctagctcatgacaacctgtcctgtgccacagctgattggagaagaggaagatgtgagtgtttacgacattgctgaccaccctgactttaggttccgtacaactgacatcgtcatccgcatcggcaatactgaggatggggctcctcacaaggaggatgaggtacgccttcaaattcaagttctggatggctgctcactgccctgtgcaccagctgcagtccctgatgctgccaccaggtggctctaggagacaagacctgaaagtcctctgggctcagtgtcctcagaagggcagctgcccagagtcaagctgccgctcagcactagcagctgcagaaggacttgtttccctgcctcccttctggggtcaggcttcttgagctgccgctggttacatttaccagaggagctaagttccttgtcacaagccaggtgggcatgatgtcagtcactgcagagcacaggaggggctggggagctggagcttgagctgggccccctgactttgtcccctttgcccagcagccatcggtgggccaggtggcccgtgtggacgtcagcagcaaggtggaggtggtgtgggctgacaactcaaagaccatcatcctgccccaggtgaggctctggcaagacccccctgctgagcttgtgactatggcaacttgggccgggggccacaggcgtgtagccagaagatgggctctcaggtcttcctggtgagatctcagcgaaagcgtgaggggaaaggcaggcattccacacagcccttggtgcaggcctgcagttggcccaccagcctcgcttctcccagcaatctcttcacgtccatctctgggtgcatgtagactttcacaaacctccaggattttcctggattgtcagctcactatgctacgaagaatgcaagttccctcctaaaaggagatggagactttcctaccaccctttttagaaagctctaacagagaaggagagaaaggagagagccgacccagttctagccccacctgctgggtcctgagcagaagggctacacgggctctccttccctcgcctcctggttggagccacacagcccagctctcctctcctggtccacacagggggcaggagtgggggcgggaatggcttgccccatcaccttaacggccattccagggaacgcagcaggatatgtcggcccttctacatgtcccctcttgtcatatgttcccagctccccacacaggcctccttggctgcatcattagctgaccctgcgcttttcaggtgtgggactgggcctgccaaggtcccctaacgccttggacagatgctgacgaagtgcacagagcaggaggagaggctggaacagaccactggctggggctttgggtccagctggagggtgggacaggtgaagggcctctcccagagacctagggactgcaaaagccagagcagaggtcagggaaagggtggaatgaggttgccaaggcctcatgagcccagtcgccatcagctgtgcggatcagggatccccagagctcctccttagtggtggggaggtgacttcctgtctgcttaccctggcacttcccttctgcccccagcacttgtacaacatagagtctgagattgaggagtcagactacgattcggtagaaggcagcaccagcgggcatcctcggatgaatgggaagatgatagtgacagctgggagacggacaatgggctggtggaggacgagcaccccaagatagaggagccccccatcccacccctggagcagccggtggccctgaggacaagggagtggtgatcagtgaagaggcagccacagccgtancnctagggggctgtggccatggctgcccccatggccgggctgatggagaaggctggcaaggacgggccacccaagagcttccgggagttgaaagaggccatcaagatcctggagagcctcaagaacatgactgtggagcagctgctgacgggctcgcccacctctccgactgtggagcctgagaagccaactcgggagaagaagtttctggatgacatcaagaagctacaggaaaacctcaagaagaccctggacaatgtggccattgtagaggaggagaagatggaagcagtgcccgacgtagagcgcaaggaggacaagcccgagggcgagtcacctgtgaaggctgagtggcccagcgaaaccccggtgctgtgccagcagtgtggcggcaagctggcgtcaccttcaccagcgccaagggcgaggtcttctccgtactggagtttgcaccctgtgagtcagcccttgcctggtcttcgccttcccccgccttctcggggctcctgtttgtgtcaccagatctgggtgcagggtggttagtcccctcgccagaccccagctactgccccagggcaaaccatttccctgtgtggtcacagtgctgaggccagcagcggcgagtgggaagtctgtgggtgtgctcacctgtccagccaggttggcagatggagctccagggcctctccatgagggactgactattctcttcccccctctagcaaatcattcttttaagaaaattgagttccagcctccagaagccaagaagttcttcagcacagtgcggaaggagatggcgctgctggctacctcactgcctgagggcatcatggtcaagacttttgaagatagaatggcaagtaggcttggcatgggcaggtgcagatgtgctgtgtgggcacccagccaagaggccaccaaccttgggtccccaaacctccggggctgactggcacctgcgaggacactcacccacccaccttttacaggggcggtcacaggctcagtcaggtgagggctgactcagccgtgtgtccaggccagatggttctttctttcctccctcctttaaaaaattactttctcggccgggcgcagtggctcacacccgtaatcccagcactttgggaggccgaggtgggtggatcacgaggtcaggagatcgagaccatcctggctaacacagtgaaaccccgtctccactaaaaaaaaaaaaaaaattacaaaaaactctcccgccaccatgcgggcgcctgtagtcccagctactctggaggctgaggcaggagaatggcgtgaacctgggaggtggagcttgcagtgagccgagatcacgccactgcactccagcctgggtgacagagcgagattctgtctcaaaaaaaaaaattactttgaaataggccgggtgcggtggctcacgactgtaatcccagcacttcgggaagccgaggcaggtggatcacctgaggtcagaagtttgagaccagcctgaccaacccggtgaaaccctgtctctactaaaaatacaaaaattagccggatgtggtggcgggtgccagtaatcccagctactcgggagactgaggcaggagaatcacttgaacctgggaggcagaggttgtagtgagccaagatcgcaccattgcactccagcctgggcaacagagcgagacttcatctcaaaaaaaaaaaaa

SEQ ID NO: 13436 - DNA, 345 bp, Homo sapiens
aaaaaatatttttacattttcatgtatcaccataagtacataatattttgtatgatttgtttacacacagaatatgtcgtcgtacacatcatctctaatttgcttaagaccaacctgtgttgattcataatgatctagtttcttcctttttacctgcaaaataggatgacagcatgtggccacaccacattccattttcccactcctctgttcgtggacggggcctagtgtctctgagtcatgtttactgaggcagcgctgagtgcatccttccggaacaggcaagcccgtttgcctgccaccttgttgactccgcagtcccttactgggcctgtgcatcgagcc

SEQ ID NO: 13437 - DNA, 487 bp, Homo sapiens
ggcgtgtgccaccacacccgtctaatttttgtatttttagtggagatgaggtttcaccatgttggccaggctggtctcgaactcttgacctcgggtgatctgcccacagcctcccaaagtgctgggattacaggcgtgagccaccgcgcccggcagtattagaacttttatttgcatttttggtagcttttttttctcatcctttaaggttccactttgtctctctcagtacaggatgatgtgttagttacaatagtacatggacacacacagcaaacaagtagatatacagggggtgcgtgagcaaacaggtttcaggaccactgctctctggagtcttattcctcagagtatgagcccttgaccaaggagcatggaatgcatcacctatgtttgaacaagggcgccagatgacctctgcggacccagggtttgggaagtgctgatgtggagccacaggacttgttttagggcgtgtggggcgtgt

SEQ ID NO: 13438 - DNA, 345 bp, Homo sapiens; identical to SEQ ID NO: 13436

SEQ ID NO: 13439 - DNA, 7793 bp, Homo sapiens
gcttctgccaccgccgaccacggccctgcgccccagccaggcctgaggacatgaggcggccggcggcggtgccgctcctgctgctgctgtgttttggtgagtcgtgaaggtgcagggtcctggtggtgcagtcccccaccaggctccgctgcactgcctggggctccggctcagccccctactccctgggacaggctggggctgtgggacaggccatcatccctcctgcccctgagcaggtgggaaggctccagatgtgccaagtggggagtccaaagtggggaggcagggtgggaggtgtgcgcacaggccccagaggaccccaccggcataactgggcagcacctcctcccatgcctctccgcgggcactggtgtgccagctctggccaggctccctgcttcctgccacctcggcctctccccccattctctaggtgaggacaggggcctcctacgtgcaggatgtgaactcaggctccaagtgcctggaccatcatactcggggtgggagggtggccgagccgagggctgctgcctgtgcccggaagccccagcaggctggctgcaggctcagtagagagctgggggcagggggtgtaggtggcagagggccctgtctcctgctgacagaggaaccggtgatgcgccaccgtgccctctcccagtcctgggtcagggacagcaggtgccagccagggggccccacctgccaggcccctccctgcgggccgggacactctctgtcagggaaaacctctcacattcctgggctagcctagccagtctggcagccaccacacttccctgtcctcaagtcacctcccagggctgggtcaggtcatcccaggctgcagcttagccagtactccaggcttccttgttctcctgggtgggagggcaccagtggcccctcagtggcccggcctcccccaccccatgcccccagtctcccagcacaaggatggtgccctctgagcaagccatgtgcacaggaggtggaaggctgtgactgcccctgagcggggtgaggaaccaaggtcattgccaaaactctttggcaatgagttttgcagtcggttcactaacagctgtgaccagaggctggactcctggacacgtcctcactcccagcccgagggtggcactcccaccaggtctctggctggtggtacccactaagcttcaccatccccaccagctaccagcgaatcacaggcccaggccccaaacaatgctcctgacacccccggcacccctggctgttgcttccagcccccacagggcgcccaccctgaagggctcagctgtccacatcccccatttcccatcagcccccacagccacacttgtgtccatccacacattccctgagatcaggccccccagatgcagcccttgccttctcggagctcctgggctaagataagacttgattctggctccagggtgatgtagacagagctcccatcaggacagagagctcaagagagagtatagggcttccaaggtagacaatgcaagcaagcaaggaaggcttcctggaggaggcagcattcagttgggccttgatctctagatcacgattaggacttggctgggagcggtggctcacgcctgtaatgccagcactttgggaggccgaggtgggcggatcacggggccaggagatcgagactatcctggcaaacatggtgaaacccctctctactaaaaatacaaaaaaattagccgggcttggtggcgggcccctgtagtcccagctactcgggaggctgaggcaggagaatggcgtgaacccaggaggcggagcttgcagtgagctgagatcgcgccactgcactccaggctgggcaacagagtgagactccatcttaaaaaaaaaaaaaaaaaaaagactaggacttatggagactgggggaagggcatccagattgtggggtgaggggagcaagcactcagagaccagaagactctgcctaaatgagaagtacagggctactttaggaaggaaggatctgcatggggaggaggcatcgctgaaggggcagtgctcaggcagggagcatggagacacagctcctgcagactcccagagagcgagaaggcctgacagtgcgcgcccttctgcaagcaggatcctcaggcttggaaggagcaaggggtcggggggccagggaataaccctcccggtagtgtttgcattttaaagggcacttaattagcacaaattaatgagcagagcatccagggcagactctccatttcccgttgcccctgaccccgcttctgcagggcacccctttgcctgccctgcaccttctccacctcctcctcctgcccatccacagctgccccctcgccgcccgctgccttatcgtccagcaacccccggggtgtctctgcccaccagtggtgttggggagggtgccccccagactgtgaggcagacagaaaggaagaggatgccgtaaaaaccctgggggtgcttgggccctccatggccacttcctgtccccacagcccctcaactccaggggactggttatcttttccgggcagagtgaagacatggtccatagcagctggcccgggcaccggaaggcactgggggttaaggggaagctgagggcctaggtgtggggaggtggctgttctaacccctccccagctacgggcgaatcttgcccccacagaatcagacgcgtggagtgcaggggtggtgagaggactctctcaaggccaggaagttccaggctttgctaccctggggctgtacactatggtcctggctggggtctccaagctggggtagaggctccagtgtttggttaaaggcccagcaagaggccctttgtgtcctggggtgtgggaggcaatggacagcagaaaatatgttcccatccttggttcccccgaacgaccccatatcttgcttctcttccgggcccctcactttatccgctccaaagcccccttgcacagcccagcagggggtcctgggcctcgtctgccaagcctgctgcatgcctggaagaggggtcagctcttgggactctggaatcttgagaaggctgatccctggtggccaatgcagaccactgtaccttctctactcccctgaggccagggagaagcctgtggggctcgggcctcagcctcgggaccaaagtgagacttggggaaggagctcattccggagcagactgtgagagagccctgggcagctcaaatgtagagacagctcccgggcctcttccgctctgagctgttccgggaggaaaggccaaccttacagtgccagggctggaggctggaccctccccagaaacttccagacaaggatgggtgtggagtgtggagggagaggaccctttccaggatgagaaggggacatctagcctggggatcccttcactggcatctcctgaccggctccccatgtggcaaggagcatccacccttgcagataagctgtggcccatgggcctgggcctgagcatacggcagagccagccctgggggggaaactgcaggcccttgggctctccggtgaggtccctctgtggactgtccctctggagtcctcaggagctggggagggtcagtggagaggggctgcagggttggggagggcaggccaggctgcagctggcctggctgatcaccctctcctcacttccagggtctcagagggccaaggcagcaacaggtaagcacccagggccctggggtgggagggacaggagccggctggactgagccagggacactcatggccagagggaatttggaacgcacaggacactggggaattccagaggaggggaaagtgggggctgtgtggaactggagcccagaaaggagaggaggaggaaggtccacacaagagcaggacgggcagcacagagccttgaggcgcggtgcaggatgagggcggcagggtctgaggatcaccctgaaccgtgactggccccctctgggtggctcccttgcagagggcttgacacctgttctatccttccaggcacctgtttgggtcaggccctgggacaagacccttccctgggttatctcagtgcctccgtggcccccaagaggcaggtgttaggttgcctttctcggcgaggagagtgagactttggggggcagctggggagggtctgcctgtatcccagactgccccgaagcccaggcctccgacttccccaaggtcttcgggcaggtcaggggcaggagggccgaggactggagtgtgaggctgagagctgggcctcggccatggaaccagccccagtgagcgcccccacccgctccccatgctcccccagcctgtggtcgccccaggatgctgaaccgaatggtgggcgggcaggacacgcaggagggcgagtggccctggcaagtcagcatccagcgcaacggaagccacttctgcgggggcagcctcatcgcggagcagtgggtcctgacggctgcgcactgcttccgcaagtgagtccgcccgcccctgcccccgcccatagcgctgacagcgccccgcgcgcgaccggttcagcaccgtggacagcgcccgccgcgccaaatcctgcgggtgacctccctgggggctcctggtccagcccctcccacccagatgcttcccttaggtccaactccagggctaacttccagttgcaaccgctgctcccgcccgcgggaggtggcctcgcaccgccccccgaccccctccatcccctccacccactcacccactccctgtgggtccctgcagaagcggcccggcaggctctgcccaccggcccctcctggcctttccccatcccgcacacacctcagctccaggacactcttcccgggaggaactctgctcacaaagcccaaggaccagacagaacggcccttcctcccctcacccacctgaaccaccccagaaagccctgagcagaggccaggccacccagccctctgccatgtatgaaccacctggtcccacaccttccgggtgtcccaggccccctcacctcacacctcaacaccgcagctctaattattttaaaccccacatctttttcttttttttcttcttgatctttaaaagaatatcatgacaaaaaaaaccccacatcttaaattcagatactcacggccaggcacggtggctcacacccgtaatcccagcactttgggaggccaaggcgggcagatcagttgagcccaggagttcaagaccagcccgggcaacacagcaagaccctgtctctactaaaaataaaaaaaaattaaaaaacaaaaaacaaacaaacaaaaaaaccccaggtgcagtggtgcctgtggtcccaagtactcaggaagctgaggcgagaggatggcttgagcccaggagttggaggctgcagtgagctacagttgcactgctgcactccagcctgggtgacagaatgagaactctgtctctaggggaaaaaaaaaatcggaaactcgggctgagagagggcaggtcacctgccagaggcccgcaggtggggctggccctgctgcacctggagggtggttctctccgagccagcctttcaggtaggcactgtgactgtccccacagcacaggtgagaaagctgcatcacagagaacttgttaagtgacttgcccaaggccacacagcggccaggggtggaggtggaaatctgagtcgggcggtctggcttcaatgtcaacacgcatcaccgctgcacctggctgtcctagagatgactctcgaagacattgtgcagagagaggtgtggggcacggtggtggccagaggagccccagcccctcccgggcctgtccccacacgaggggccgcctcacgccgcctctctgtttctcccgccagcacctctgagacgtccctgtaccaggtcctgctgggggcaaggcagctagtgcagccgggaccacacgctatgtatgcccgggtgaggcaggtggagagcaaccccctgtaccagggcacggcctccagcgctgacgtggccctggtggagctggaggcaccagtgcccttcaccaattacatcctccccgtgtgcctgcctgacccctcggtgatctttgagacgggcatgaactgctgggtcactggctggggcagccccagtgaggaaggtaaggggacagggctgggaaagaatgggggatatgcctcaagaaggcccaggacggcttggggaccactctgaacccacaatcttcctgttgctatattaatacatacacacggtctctgttcacacaggtggggccgaggggagcagcagcagacccagaaggaagagggggtgaagggagagggggacagaaagggcccagcctgctgcctggaaggagggaggatgtctgccccacagtgccctaagccagagatggtctaaacatgaggaaacgacaggcaggatggagtggtggttcccggggccgtgggttcttgatgaggaagtccgttgagccctgggctgttccgcccctctccagacctcctgcccgaaccgcggatcctgcagaaactcgctgtgcccatcatcgacacacccaagtgcaacctgctctacagcaaagacaccgagtttggctaccaacccaaaaccatcaagaatgacatgctgtgcgccggcttcgaggagggcaagaaggatgcctgcaaggtgggagcaatgtggtgtccatggggactcagtccccaccgccaggcccagggcagggtgggatcatgccccgctccatgggctatgcattcaaccagctgagcagcttgttttgaaaaggcagattccagggccgggtgtggtggctcacgcctgtaatcccagcactttgggaggccaaggagggtggatcacaaggtcaggagatggagaccatcctggctaacacagtgaaaccccatctctactaaaaatacaaaaaattagccaggcgtggtggtgggcgcctgtagtcccagctacttgggaggctgaggcaggagaatggcgcgaacctgggaggcggagcttgcagtgagccgagatcgcgccagtgcactccagcctgggccacagagcaagactccgtctcaataaaaaaaaaaaagaaaaagcagattcctggaccccaccccagaaggatcagagtcagtgggtctggggtggggcacaagaaactgcattttcaacacacacacacaccctagttgatctggggacactaaagaataggcactttagacaatcggactggcaggggatggggagccgggcagagaggctctgggatggagagaaggaatccattgcggagctacacacctcctgtgcggctgcaactgagtctctgggaactcaaggtgggctctgacggtgactctgcgtcccccgcagggcgactcgggcggccccctggtgtgcctcgtgggtcagtcgtggctgcaggcgggggtgatcagctggggtgagggctgtgcccgccagaaccgcccaggtgtctacatccgtgtcaccgcccaccacaactggatccatcggatcatccccaaactgcagttccagccagcgaggttgggcggccagaagtgagacccccggggccaggagccccttgagcagagctctgcacccagcctgcccgcccacaccatcctgctggtcctcccagcgctgctgttgcacctgtgagccccaccagactcatttgtaaatagcgctccttcctcccctctcaaatacccttattttatttatgtttctcccaataaaaacccagcctgtgtgccagct

SEQ ID NO: 13440 - DNA, 297 bp, Homo sapiens
ggcacctgcctgtaatcccagctactcaggaggctgaggcaggagaatggcttgaacctgggagacggagcttgcagtgagccgagattgcgctccagcctgggcgacagagcgagactctgtctcaaaaaattaaaaaaaataataataataataatgaatgaagctggacggacttcgcgtgcaccgcggtcagctcggggtctgctggggggtctgggtcagctcagggtccaggaaccgaggccaacggcaccccgtgctgcgctggggtgaggggtctgccctggggtctcg

SEQ ID NO: 13441 - DNA, 1048 bp, Homo sapiens
ggccctggagacactttgactgtggacttcaggcctccagagctgaaggagaatgaacacccactttggggtcacgtgttacagaagctgcaggaggatcccgcaatggccagcatggcacacgcctcagggcctcagtttccccagctgtgaaatgaggatgatgacaggacctgcctcacaggcttgcagtgaggataaaatgagttgatatgcatggaatgcacgcagcagggaccggcacggaactgacattgagtggatgtcagcctctgtcaacattactattactattactgtattattgcccttcgttcgttcattccataaatatgtgcaaagcggctgctctgagccttccgtgggcagcagggcagcacagaggaggcctgagcggtggtgctggggagaggatggcgtagggcaggcctcgtggacgcagccgggggcctcaccatcagcataagcgaccacggtgggcttcagaaggagcgatgagacaggattcaccccattgccatttgcttttctatcggatcaggaagaagcatgggatgaagctggggtgtcaaggagggtctcccttcctcggtggtcacctgaggtgctggggccccacctttaactctctctgctggacctggaagctttgcccaggtccctgggaccgtcgcgttcacaggcttccaccgaggctctcgctgggtacattgacttgacccacttcagattttgttttcttaaaactcatccccaagtacactttgggaggccgaggcaggcagatcgcctgaggtcaggagttccagaccagcctggccaacatggtgaaaccccgtctctactaaaaatacagaaattagctaggcgtggtggtgcatgcctgtaatcccagctactcaggaggctgaggtaggagaatcgcttgaactcaggaggtggaggttgcagtgagctgagaacacgccactgcattccagcctgggaaacaagagtgagactccatctcaaaaaagaacaaaaaaatgattaaaaaccaaaaaaaaaa

SEQ ID NO: 13442 - DNA, 10923 bp, Homo sapiens
gcttccccttcgtcttcctcctgggcctcctgccccaggtcaacacctgcctcatgtacctgctggagcaaatagatatgcacggcttcgggggcacaggtatgatgccacaggtggctcagggatggggcccgtgtggaggcaggagggccctcggattgggtccttggctccacccttgcggaaccttctcctgcgtctgtactgcagactcaaggtttctgccttctcccctctccttccctccccaggcaagtggtttatatctgagaatcttggaagctctaaaggccgcttggggcttggggcagcagagaacaatgggctgggggtgcctttccagggaggccagcctctgggagttgaggggaagcgcggctagggttgaggtggggtacctgcaagtgagagctgggctgtacttctcccttccacacagctgccaccagcccgctcacggcagtcttcagcctctcccgcagcctgctgctgccctgctctacggtttctgccttggggccatcaaggtaggggtggcttgcgaggtgggggcatgctgcagtgcgtaagggtggttggggcggggctgtgaactgggctcagcagtggcttctcacacgggggcagcccgggccccatgcttacctcacctcccctgaccagcatggattctctccgcagactccgtggccagagcagcacgtccctgtcctcttctcagtcttctgtggccttctggtggcactgtcctaccacctgagccggcagagcagcgaccccaccgtgctctggtgggtgtgctccgggtcgtgtgtttgtgtctgcccagtaggggtttgtggtctgtgcatgtgcccgtgactggggccggggggaaggaggggcggcctcctcctgactcttcctcacccccaggtctctgatccggagcaagctgttccctgagctggaggagcgcagcttggagacagcccgggccgagcccccggaccccttgccggacaagatgcgccagtcggtggtgagggggcggggggtgggggtctgtggggaggtggtgacaggtcctggggttcctgggaggggcatgtccagcttgggctgctgggcagctgagtgtctctcctggccgggcagctgaatgtctctcctggccctgcagcgtgaggtcttgcactccgacctggtgatgtgtgtggtgatcgccgtgctcaccttcgccatcagcgccagcaccgtctttattgccctgaaggtttgtgtggcatgggccgctgctgcctctcgctgtcttggcgggagcctgctcaatctgagtgccgtgggcagcccctccccggcctgtgccaggtggccctctgtggtcccttggcctgctcccatcagctgagtctctggcctctccctcctgcagtcggtgctgggtttcgtgttgtacgcactggctggggcgtgggcttcttcacacattacctgctgccacaactccgcaaacagctgccctggttctgcctgtcacagcccgtgctgaagccgctggagtacagccagtatgaagtgcgcggtgagtgcccacccctgatggccaggcctgggcagtggctcgggctgcagcctggctggtgggagctgtggtcctctcggctcaggagtgccagcagggggcactcgctgcccacactaccctttctgctccctccctgccctctgtgtccgtgttgcccggctgcgctctccaccgactcttctcctcgtgccctgctgtgcccttcccttgcctgtgttgccctggtcctgccctccttcctgtctgtgagaagacggaagaattagaaccccagggccctgaaggatctcttgtccagaattaaacactgatcaccagtggaccagagctgcctggagcacatcttcactgggctgcataatggtttttaaaaaatcctggagcctctattttagcatctcgatttgagatatgaagatccatgtttcttgagtttttcttaaacgacagaagattttgcttcccagactagcatccctctgtggctacaaccagcctgaaccgaggggtctgccctttagaagggcccagctcacgggctcactgtgcactcaggccctagccagcctgctgtacgtaggtgtttgcgatttcatcattggccttgttttaacagacagcagagcagagcacctgccataaagcaagcctcgatgtgctaagtgccatgtggagcccttgccctgctggggctcgctgctcccatttgagctgccacagatcagcccctccccccagggtctccgaggagtcaggaccgcacagcctgccctcctagggaaggacttcctcagggaaggcaggcatgtggaagccaggtgcagagtcctggcctctccacacaggtgccgcccaggtgatgtggtttgagaagctgtatgctggcctgcagtgcgtagagaagtacctcatctaccccgccgtggtgctcaacgccctcacggtggacgcccacacagtcgtcagccacccggacaagtactgcttctagtgaggaccaccccaccctcaacgatcccatcatccgctttcccttttgatccgtggggaaactgaggcctagagagggaatgaatcatgtctaaggttgtttagcaagctaaagcaggaccccagctcctgacacgccatcccaggaagtggttgcttcttcaaaggcaaatgtgttcccaccactccctttggaagagcagagactaagagtcacgggcccaaaagagcagggaccagcccagcagagcagaggccaggggttgctctccggccagagtaggcgagggatgggacacctatacccactgccccgcgtcccctaccaagcacccgatgcctgccccttgcccacagctgccgggcgctgctgatgaccgtggctgggctgaagctgtgcgctcagccttctgctgccccccacagcagtacctgacgttggccttcaccgtcctgctcttccactttgactacccgcgcctctcccagggctttctgcttgactacttcctcatgtccctctttgcagcaaggtgagttggtggctgtggcccagaccccaggctgtccaatgggagcagagccaacttctgcctgggtgggaagagaatttcctgacggtgtggccaccgctctgtagtcagccccgtgggcctttgcagcagcctctcaaggaaggggttacttccaccctctacagagaggaagcaggctgaaggaggttgagggacttgcctcaggcttccagagaattggtggtcagccaggatttgaacccaggcctgtctgaccccacgaccacctcctcagaaatggttagggtaatcaggacctggccttatcctctggacgcagacctctgagttccacgctcttttgccaccctggatccagagcagtccgagctgagtttcagaagcccctagtgcctgggtgtgtataggtgctctgccggcttgcattccacggcttggggggctctttgaactaaggaaccatgctcctacactctactggaggccagcagtggtacctggaacccaggcaggcctgagcctttttcttcctcacgtgggcattctgttcttgttttctggcctggcccaggatggcggtcatccacactgcgtaccctctgagggcagggctcgtggctgttctcaattttcagtactatagtctagcttcagcctcaccagtgacctagtggcgtgacctgaggaagtcatttatcttctctgtcttcactgaacctcaactttcccatctgtgaaaaggggccagcaataggaataagaagctcacagggtacttgtgtgaactaaatggccaccgccccctttgagctcaggcaggggttgctaatggcatcaggcgccttgagccatgtccagagcacaagggctggcagtgaccttgagtttggcccccgtggccaagccagtgcgatgacccaagcctctgaatggggcctggcatccgggggcttccatgagtgaccctgcatgtcttttttcttctccctgttggccctgccagctgtgggacttgctgtacaagctgcgtttcgtgctgacctacatcgcgccctggcagatcacctggggctcggctttccacgcttttgcccagccgtttgccgtgccacgtatccagcctgtgtttgggtgggggtgtgcagggagggctgtggcctggggcagtggggggtggtggggggctgggaggtcctgttgcccgccgcctccttgactgtggctcagactcggccatgctgttcgtccaggccctgctctcggggctcttctccacgcctctcaacccactgctaggcagtgccgtcttcatcatgtcctacgctcggcccctcaagttctgggagcgcgactacaagtgagtctcacaggaggcgggagcatgccccagcagggcaggaagggagaggtttggagcccaggctggagccacccacagaggggcccacagcaggtatgggagggcttggtcacagtggggacacatgaggcggcagatccaatgcagggagagcctgcaccaggccaaggcttcaggctcacagcttggggatagtggggtctggggatgagcttagcctcccagcttcttggctgtgtgtcctgtgtgagtcccttcatgtacctgagcctcagtctcctcatctgcctgcataacggggctgtcctggatggcgttgaccttgtggcacagggagagcatgagcaggtgcaccctctcttcaccttcttggccaaccgccttgttgcactctctctgaacagcactaaacgtgtggatcattccaacacccgcctggtcacacagctggacaggaaccctggtgtgtacccagccatccaaggggctttaagggcagggcctccctggggagggagcctcgctaacttgtcactttgtccatttgcccgtctgttctgggtcttaggcgctgatgacaacaacctcaactccatcttctatgagcacttgacacgttcgctgcagcacacactgtgtggggacctggtgctgggccgctgggcaactatggccctggtgactgcttcgtcctggcctctgactacctcaacgccctggtgcacctcatcgaggttggcaatggcctcgtcaccttccagctgcgtggccttgagttccggggtgagccgcaggaccaggctcgggtgggcaggcacagctcgggcctgatgtgggagctgtgttcaatagcacgtgcgaaggaggtccagtccagctctgtccaggctggcgggtggccttgggcaaggcactcctcctccctgggcctgcgtttcccagtctgagcaatgaggtggcagggtctcttggccaagccctgtgcctgccccaactttaggtcccagtgactctacaggtcactgcagtgagggcctgggcctggaggtctgagttctcacacccagcctgctctgtggtctcaggcttggcccatgggttgggcgccatgagtgagccagctccttcctctcaggaagacgtgtgtgttggatgcccgagagtgcagaggggccagaccgtgtccctgctccctcccgccctgcccttggatgctgggagttgggaggagaaaggcaggcgctctttcgtgaatcttggcatccaataaggttgactcccctggcgtccaagggggtgaatggcagcaggcctctgatgccatgttggtcactctcccaggacagggcaggtagggattgttctagcagcccctgactgcacacccctcctccacaggcacttactgccagcagcgcgaggtggaggctatcaccgagggtgtggaggaggacgagggctgttgctgctgtgaacctgccacctgccacgggtcctgtccttcaatgctggctttgggcagcgctggctggcttgggaggtaacagccagcaagtacgtgctggagggctatagcattagtgacaataatgctgcctccatgctgcaggttttcgacctccgcaagatcctcatcacctactatgtcaaggtacggtgggcaggtgtggccgggcagcagggccttgcgggtgagcgctcgctgaccagaggccccagtaccccctttctgggttgttgggagcctgttttgtccaagggaagctgaggcctcagagagtttaagtgtcccctgaggtgccactgccagacctcaggttgcagggcctctgtgcccatatggctctgataggtgcccaggcaaggaaggcttgctttgggcagtgagtatggggcaggtgggcagttgcagaggccagcctttgaaaccaccagcccctgcccccagctcacccagcacagagcagtggtagagctaacagttgtcacgttaacgatcatcatgggagcagctgcttgagcagtaacatttaccacgggtgggcgctatgctgggcatctctcctgagctgggtggagtcccccaccctttgagaggggccctgctatctcacagatgtggaagttggcttgcagaggttccagaatctgaagaaaatggccaagccaggccttgaacccaggctggcctgagccacagagctttcctgccttagcctgggggctctgagccaggcctgaggatcttgagacctcttgggggtgggagggggttggtgaggcaatgtggggtacataaggagccctggaatgggggttctgatcagcctggaatgtttcttccctgtgtccctcagcttaccccttgagaagtgggggttattgcagttctctgagatggcagaaatgttgaggcttggccaagcgtggtggctcatgcctgtaatcccagcactttgggaggccaaggcaggtggatcacttgaggtcaagagtttgagactagcctggccaatgtggcgaaaccccatctctactaaaaatacaaaataattagccgggtgtgatggcgggcacctgtagtcccagctacttgggacgctgagacaggagaatcacttgaacctgggaggcagaggttgcagccagccgagatcgtgctactgcactccagcctgggcaacagagcaagactgtctcaaaaaaaaaaaaggaattttgaggcttgtggtgctcagaataagcgtactgggagtggggtggcctgctgatcacagtgcaggctcccacgtgccttcttaggatctaccctggtgctccctatgttgggctcggtgggtggcctactggggcccaggtgagcctgccacctaggttctctctggagtagtttcacgaggccctggctgtccttctccaaaggaaatcctgtccacaccacatatcagaggagctgtcatttgtcattccttctgccctcccagccactcctaggcaaggatttgtgagaccacccccctttcatcaagaaggaggctgtgtctagagagggacattcccagtcccaggtcaccgagaggtcatggcctggtccaccttccggtcccatcttgagagaggtgcccttgcccaggttgccctgctgtgcctgctaggctagggccagcaggttgagatgcacctggccaggtctcttgtcccatggggaagctgactggccacatctaaggctgcctcaaaggctgggcagaatttgagtctggaggaagtgcttggaggacctggggtggctccgctgaggatgtggactgagggtgaagcttggaaggacaagtcagggctgccaggggtggggcggggggaggcgggtgtgctggggagcctggtgcatctggggaagtgtcccagctgcagggataggtcctttccagccttcgaggttggccagtcgaggcggagcccctcccgttagctttgcccttcccgtgggagttactgggctctcagacctgcttctgcagctgggaagggctacaagagcaggaaaaggcaccgtggcttgaggctgcacggagtctgggcagtgcttcccgggaagtaccttgggcagaacgctcgcagtgagcgctcacaggcggagcggctgctggtattgccccccgtcttcattttcttcctaagatgaccgtgagtgttgtgtcagagaaaaggatggcactggtgaaggttaaccaagcacctgatatgtgccaggccagctcctctcccggtccctgaagcttttcttttttttatttttttttgaaacaaggtctcattctgtcacccaggctggagtgcagtggtgccatctgggttcactgcagtgtccacctcccaggttcaagtaatcctcctacctcagcctcccaggtagctggactacaggcatgcaccaccatgcctggctaatttttgtattttttgtagagatggggtttcgccatgttgtccaggctggtcttgaactcctgggttcaagcgatcctcccacctccacctcccgaagttctgggattacaggtgtgagccaccctgtctggctgaagcttttcttttctgggtctttttagcagctctggtggtgcctggattgtagaggcgagctatgggcaagaaagtcagtctggagcgggtctgccctggcaaaggcgctgcccattagctccatcttagggtggcacatggaatccccatcacctcactggctgccctgccggccttaacccgcccgtgcatcctggccatgccagctacctgtcttccaaagctcctgtacttttgcccaacagggccttttaacaagaggtccaggagcccccagctttgggtaccacatgtgcccgtggcttttttctgaggcgaggcctgatggctgtcatgcttcagctgcctaaagggacctgtgacccaggcactctgaggcaggcccactacttcagcctgccttccggccccgagatctggatcccacaatgtcatgatggggaaggtccggggttcaggcggcagttcagtctgttctgccccactcgctccccgccccctgcccatgtgacatctggatgctcccgcgctcggggttatgtttgtgcaggaacaccagctcctgctgctacctggcccacgtgctgcacaggcactgaaggttcacctgagggccacaccatagtgtcggggccagccagaggcgggtgggggacagggttcagggcaggtggggccagctccaccttgatgacttggaagctgaggtggtaaatgttgagtgtgatgatcttgttctcgttgggggctgccatttgtttgagcctcaatttctcatacaaacggggcatattctagggcagaggcaggcagatgctgcttgtgagtgctagccccagcacaggacttcctgctctgtaagtgggtgcttcctggcggctttgtcactcctccctggtctaggggaaggagccaacttgcttggttgctcttgagagctgagatggctctaggagcggggcatcccagaaagcggacttcagctcagtcttggggaggagcctctgaacctccatgctttctcctccagtggccagggcgtggaccccgcctgacgcctgcccctcctctcccagagcatcatctactacgtgagccgctcaccaaagctggaggtgtggctcagccatgagggcatcacggcagccctgaggcctgtgcgggtgccggctatgccgacctcggatcccaccttctcgctgagtgtggatgaggactatgacctccgcctgtctggcctctcgctgccctccttttgtgctgtgcacctcgagtggatccagtactgcgcctcccagcgcaggtcaggctccactacctgaggctgccacctggcgctgtgggactgggcttccctgctccccttctccccatttggtttcctctcactctgagcctcccttagcctgagccccagcccccactccaaggtccctgtcccaggtctgagctgggctctgggatgggggtccttatgccacagcccgtggaccaggattggaactccccgctggtcacgctgtgttttggcctgtgtgtgctgggccgccgggccctgggacagcctctcacagcatgtctgcaaggtgagtgctcgggtgtccgcgggcctactgccgtccccaccccacctcttccacgaagagcactgtggtctctggccacagtgccacagaaactgcagtggcccttcctgttggggtacctcttctcccacgggcagggcacttcctggtcatgaccttgcctgctcctcagtgctctgtgagagacatgggcagagattggcctctttgtcaagatggggaaactgaggctcagcgtgaggaaaggcctctgcttggatcactctgaagccttacccctgggtcctcgacacccctctctcccctccctgtttttcctcccacttagcctggagcccttcctctacggcctgcacgccctgttcaagggggattttcgcatcacctccccacgtgacgagtgggtctttgccgacatggacctgcttcaccgcgttgtggcgcctggggttcgcatggccctcaagcttcaccaggttggggaggggtgtgccagcagcatgggcaggtgggggatgaagcctctctccagggcaggggcactgacccctgttcccgtcttctctaccaggaccacttcacgtccccagatgaatatgaggagccagcagccctatacgatgccattgcggccaacgaggagcggctggtcatctcacatgagggtgaccagcatggcgcagcgccatcctcagcaacacgccctccctgctggctgcgccatgtcctggatgatgcctccgacgagtacaagatcatcatgctcaaccggcgccacctcagcttccgagtcatcaa

SEQ ID NO: 13443 - DNA, 353 bp, Homo sapiens
cgtcgcaaagttataggtgttcacatcttcagaggacaagggtctggcatgggcacagtcccagagctgggcctttagggcaagatccatcttccccactgccccactggaaggtgaggcaagacgggcacgccctgactaggctgtccctgcaggacgcggggagtgctggagaacatcttcggcgtgggcctgagcagccttgtggccttcctgggctacctgctgctgctcaacggcttcttcactgacatctgggtcttccagttctgcctggtcatcgcctcctgccagtactccttgctgaaggtcaggccgggctctctgtgtttccttccccacccgacttttcc

SEQ ID NO: 13444 - DNA, 1847 bp, Homo sapiens
  misc_feature (1691)..(1691): n equals a,t,g, or c
gagctggtgttcctgcgcaaccgcaaccccgagcgtggcagcatccagaacgccaagcaggcgttcgcaacatgatcaactcctcctgtgaccagccgctgggtaccccatctacgtgtcgcctctcaccacctcgctggctggcagcacccccagctacgggcactgtggggtggccccatcagcctgggtgccattgcccactggctcctgcgcacctgggagaggtgaggcctcgggaaggggtgacgtgtggcgcgggaggaagctgaggtgcagtacgtccctcctgggtctcagagggaggacgtgctggagccagggcttgaatcccgagagatgaccccctcccagagctgacctgcccctcctagatgtcaccttacccccagagctgacagtggcctttagtcatcaagcactgttgacaacgcaccctcaaaagactctgcaaagtaggtggcagcttcttagaggggaggatcctggggctcagaggtgttagatgacttgtcctggggctgaggactcatgcttgtgaggcctcttcgtcagccgtgtccctcctgatcccttttctacctctccacccccaggcttcacaagggctgtggcgccggctgcaatagtggcgggaacgtggatgattcagactgtagtgggggcggtggctgacctccctcagcaataacccccccgtggcacaccccacacctgagaacacggcaggtgagcaggcgaggctgggctgaacccgtgggtgaggagtgcagcccagctgaggcctctgctgtcttatctgtctcctacaggcaatggtgaccaacccctcccaccaggccctggctggggccgcggtcctccctgagtggctctggtgatgggcggcccccacctctgctgcagtggcctccccctcggctccctggaccaccccctgcatcgcctatccccacagagggtccccggacctcacggccccctggcccgggtctcctcagttctgagggccccagtggaaagtggagcctggggggccggaaggggctgggaggatctgacggggagccagcctcagggagccccaaaggaggtacccccaaatctcaggtaaggcacctgtgggagggttgggtcccagaaggctaaggcctgctcacccgccaacctctcccccctcccccaggcgcctctagacctcagcctcagcctcagcctcagcctcagccccgatgtcagcactgaggcctcaccccccagagcttcccaggacattccttgcttggacagcagtgcccctgagagtgcacacctatgggtgccctggcgactggcctgcccctattgaggagcgtgagagcccggcagcccagcccctgctggaacaccagtactgagctacctggcgcccactggaccacctcctaggattcagtaacggacctgctctgctgcctctctgctggaccacagaactgagtggctttggcctacatgtctgaaccctgacctttggctgccttggccagagtaccaaaactgagtgacccagacctctgaccttgacccctgatctctctcatccccagtccagggcctgggctccccagatgagcagtcagcctcccagccagccctaagagccaaaccatgggctggtcccacttggagcttggccaggaccacctcancccctgggctcactgcctgcaggtgtgccccttgcctgacctggggcctgaattgtgggaagggtggtttctttcgtgccttttttttctgttcttttttttttttttttttgtgcttcggagacatcagaattaataacactatttttgattttg

SEQ ID NO: 13445 - DNA, 13893 bp, Homo sapiens
  misc_feature (4607)..(4607): n equals a,t,g, or c
  misc_feature (4619)..(4620): n equals a,t,g, or c
  misc_feature (4627)..(4629): n equals a,t,g, or c
  misc_feature (4640)..(4641): n equals a,t,g, or c
  misc_feature (4643)..(4643): n equals a,t,g, or c
  misc_feature (4654)..(4654): n equals a,t,g, or c
tctgaagcttctgtcgaaccagttgtaaggagaatggagagagcagtgagagtggagtccggggtcctggtcggggtggtctgtctgctcctggcatgccctgccacagccactggtaagacacacctgctgggcctgcagaggtacttggtgtggaggagtcaagagtgagacagggacagggagcagtgggccgaccgctcaggaaacagtcctgtttggaggcagaccaggggttgtgcattctctctgggcaggcgctctgctcttgctgtatttgtttcgttgtttttgttgttgttgtttgagacagagttttgctcttgttacccaggctggagtgcaatggcgcgatctcggctcactgcaacctccgcctcctggattcaagcgattctcctgcctcagcctcctgagtagctgggattacaggcacctgccaccatggccggctaatttttgtatttttaggagagatggggtttcaccatgtgggccaggctggtctcaaactcctgacctcaggtaatccacccactttggcctccgaaagtgctgggatcacaggcatgagccaccgcacctggcctgtctttatgtcttaagggggcctgagatttgttttaatgaagtatagtaagacaagcagatatgcaaatgactatcatgagggaaggagtttgctcgtagttccctgtgaacaggaagcaggccatgccacatagggccacagagggaagcaccaggtggcatcagccaggaggcagagggagcagggggaaaatgtgggcaagcccctttgacacggttgccacgggaaggaataggcaaggcaggctaaagaggtttacgattggcagcaggctctggggaaaggggctgtccccagccagcttcctggtacccggctctgtggtgattatggctggtggatggcagccaggagctgagagctgtataaaggaggtggttgggtatggctctggactggtttgcctttgctccctagagagatgcctgccaattccacctccccagagagctgcctcctatctctaggaattgtctagcctgggagaggcagtcctccagtcttagtctgtttgtgttgttgtaaaagaatacaggaagctgggtaattcacaaagaaaagaagtttagttaggccacagttctgcaggccgtacaagaaacatggtgccagctgggcatgatggctcacacctgtcgtcccagcacttggggaggctgaggtgaaaggattgcttgagcccaggggtttgagaccagcctgggcaacataatgagaccccatctctactttttaaaaaataattcagggctgggcatgatggctcatgcctgtaatgccagcactttgggagccccaggtggatggattacttgaggtcaggagttcgagaccagcctggccaacatgatgaaaccccgtctctactaaaaatacaaaaattagccaggcgttgtggtgcacacctgtaatcccagctacttgggaggctgaggccctggagtcgcttgaactcgggagtcagaggttgcagtgagccaagatcgtgccactgcactccagcttggtcaacagagctagaccctgtctcaaacacaaaaaataaaaacaaagaaatgggcaagtggctggccccaaggcacaaggccctagtggcaggcccggtctggcctggagtggagtggtagtgactctcaggcaggcagggaggaggaagttgggcgtcaacctaagaccaggctcaccggcttgctgggaaggttaccaagatgctgtgtggtaagtactgagaacagcctgagggtttgtctttcactccttcccctcatgggggctgcaaactcaccccgtggcctttctgtccttccctcagggcccgaagttgctcagcctgaagtagacaccaccctgggtcgtgtgcgaggccggcaggtgggcgtgaagggcacagaccgccttgtgaatgtctttctgggcattccatttgcccagccgccactgggccctgaccggttctcagccccacacccagcacagccctgggagggtgtgcgggatgccagcactgcgcccccaatgtgagtagtgctggtggaggcgggcaaacaggcaggttgcaggagaatcctgctgctggggcttgtggggctgaacagctggacctcaggcccacccttggccacaggtgcctacaagacgtggagagcatgaacagcagcagatttgtcctcaacggaaaacagcagatcttctccgtttcagaggactgcctggtcctcaacgtctatagcccagctgaggtccccgcagggtccggtaggccggtaggcaccccagagggccctgtccacctgatccagctccactatgcctacctgtcccctccccgtccctgtttccaaagcaccctagcggtcctgagactgcctgggctggcaggtgggcagctaaggtctcaggagcttgggggtcagtgccccatggccacctctgcaggtcatggtatgggtccatggaggcgctctgataactggcgctgccacctcctacgatggatcagctctggctgcctatggggatgtggtcgtggttacagtccagtaccgccttggggtccttggcttcttcaggtgagacgacaggcatggccagagcactgcctgcaccggggagaggccagctcaccagagcaactggggatctaggttggggtccggaacctgaagggagggccccttacccatgatgtctgaggcagagaagggcaccccccaagcctccaccctgggagaggggtccagccaaagccagaattatacagtgaacttggtcccttgggcagagggcattgattcctgggctgaagcccaggttccagcaggatatgggacaaagagcaacaggctgtggagatgccaaccacggctcccagacaggccagacctggggagcagagaagggtctggcatcctggtggctaattcaaagcaaacctgcagaggctggcgaggagccaggctgaactaaccgttgccccaacactgcccccagcactggagatgagcatgcacctggcaaccagggcttcctagatgtggtagctgctttgcgctgggtgcaagaaaacatcgcccccttcgggggtgacctcaactgtgtcactgtctttggtggatctgccggtgggagcatcatctctggcctggtaagtcactatagggggctagtgatggtggccaggagggctccggtggtctcagaactcccagctcctctgccctcctctgacagccacctcctctctccaatgcacccaggtcctgtccccagtggctgcagggctgttccacagagccatcacacagagtggggtcatcaccaccccagggatcatcgactctcacccttggcccctagctcaggtctgtatttccttccctctcttactctatgtgtgcctcccataccccactctgtgctggccctggggtctcagagtagcggggtttgctggcagggagctccctgttagcaaagagaagcccaataagacgaaggagcatcagaggaaacaactgctgcattccagcatattggcactcagggagggcttcctgaaggaagccaccctgaagcatatcattgttggccctttctccagggtggggtcttcaggagcacccctctctgccccaggcagcatggtggagggggtctccattgccagccacctgctgcctgcgagctctccattcaggctccagatccccaccctagatcctcattgtaaggccttgtgaagaaaatccaggggaagccacagtgggaactgcatctgcaaaggctgcaggtgtgggagagagtgacaggtcctgcaggagcaagctcgcaggttagggaacagggcaggaagtgaaggtgctggagaagtgggggccatgcctgggaatctggactttctccagagggcaggaagaagttgggcaatgacaaggttgagctacctggagtagaaggtgggttggagggagccgtcctgaagatcaagacaccagtgaaatgaccagggcagagtccaggagaaagagacaggatggaatagggatagagccatcggggagagagggggcaaatgtgagcaggatttggaagactgggtcaattccctcacctggccccagatggtggccaaggcagtgtgggctgggcattttaaccactgtgtacaagatgattctggaacctctgcgtgggcatgttgactcttgtatggacaacagcatcctcctctcaacctccccatcccatcctctccccatggccaggagagattttctcaaccacagacttgaggtcattccctgtctctcctgtgtccaaagaaaaacacagctcaaggctgaggttggcggatcacaaagtcaggagatcaaggtgatcctggctaacatggtgaaaccccatctctactaaaaatacaaaaaattagccgggcatggtggcaggtgcctgtagtcccagctactcaggaggctgaggcagaagaatggtgtgaacccgggacgcagagcttgcnggtgagccaagnnatcatgnnnccactgccacnntnccagccttggngcgacagagcgagagtctgtctcaaaaaaataataataaaagataatgacactattcttagagggcaatgaggactcagtgcccccattcccccagataataaaattatggtataataggggacgcaagggggcccttgggaccacccaagctgacgggcagggcaggcttctcaggagtggtgacaagtctgtgaccagtctcgaggccgatctgtgacatcacatccagctgtcctacagatgcaccctctctgtgggaggcagaaggctgcaaggtggggctgagtggctgagagggaggcatgactctttcatttgtccccagaaaatcgcaaacaccttggcctgcagctccagctccccggctgagatggtgcagtgccttcagcagaaagaaggagaagagctggtccttagcaagaagctggtatggccacccttttggggatggtgccgggcaatggcacagagggggttctatccatcccctgcaggagcagaggggcagtctacccccaggtggggctggggacagcagctcatgaggggaaggggctgagggcttggagacagaaatggagggccatctccatccccacagcaggcctgtcttctaggaaagaaactggacgcatctgttgccctgatctcctggttcccccgacccccttaaccctggtgatcttcatcccttcactttccctccaggctcagacactcaggcctgcagctcagtggctgctggggtcctagcctttgaggcttggccctaacttgggagcctcctgcattgctttctcctgcagaaaaatactatctatcctctcaccgttgatggcactgtcttccccaaaagccccaaggaactcctgaaggagaagcccttccactctgtgcccttcctcatgggtgtcaacaaccatgagttcagctggctcatccccagggtgagttgctcccacccctgtgcccttcaaggccctgccccagccagtacctgccaccccagcatcaacactacagccttgtgaacggagcactcccgttactcccatttgataagtgagaaagcagaggcccagaaaggtttgagggacttgcccaaggtcacccagctttgttttgttgtgttgttgttttgcttttttttttctgtttttgtttgtttgtttgtttgtttttgagacagagtctcgctctgtcacccaggctggagtgcagtggtgcgatctcagctcacttcaacctccacctcctgggttcaagagtttctcctgcctcagcctcccaagcagctgggattacaggcacatgccaccacacccagctttcaccacgttggccaggctggtctcaagctcctgacctcaagtaatccatctgctttggccttccgaagtgttgggattacaggcgtgggccacttcaataaagcaaatgttttcttttggggaacaaggtttttgcacaaactggccttctgggcactgctgatctgggcagcatattcctgccttggcgtctggtttatacatcaggctctatgagactggttagtgtgactctgtgccagagcaattgactaaaactctcaggttttagatatcaagccaccggggacttcatgagccaagtcccttccattcctttccaggtgcatagaacttcccacaagagtgtcagcactgtgctttcatcccgagcatcttgtttctgtcattcttattcttctacccatcttcacagcaatcattttcttcacttttctttttttttttttttcgtcttggcccattgcacaccctaagacaaagcaatccatttttgttgttgttgttgtttgtgtgtttgtttgttttttgagacagagcctcgatccatcatccaggctgcagtgcagcagcgccatcatgactctctactgcctcaacctctcaggcccgagcaatcctcccagcttcctgagtagctcgggcctcaggtctgtgccaccatactctgctaactttttttttcttccgtgtatagtcaggtctccctctgttgcccaagctggtctagagcacctggcctcaagcaatcctcttgcctcgacctcccacagtgctgggattacagacatgagccacagcacccagccaacaaccacttttaatggctgcaaatcttccacaaatggagcgtctcgttacattgttctttcatcttggcatttgggcatcttctagtttttttgtttgtttgtttgttttgtttttgagatggagttttgctcttgttgcccagggtggagtgcaatggcgcgatcttagctcaccgcactgcaacctctgcctcccaggttcaagcgattctcctgcctcagcctcctgagtagctgggattacaggcatctgccaccatgcctggctaatttttgtattttttttagtagagatggggtttctccatgttggacaggctgatctggaactcctgaactcaggtgatccaccagccttggcctcccaaaatgctgggattacaggcatgaggctgcacccggtcctggcaacttctagtttttaccactgaggctaatagcgcagtgaatgtcttcatgtccatggcttttgtcctctgacttagccctttggaatcaatcccctcatattggtcccttggtatgtgagagagaggctcatgcaatcttgacattcaaagacaaagcttaagccgggtgcggtggctcatgcctataatcccagcactttgggaggctgaggtgagtgggtcacttgaagtcaggagttcgagaccagcctagccaacatggtgaaaccccatctgtactaaaaatacaaaaattagctgggcgtggtggtgcatgcctgtaattccagctactcaggaggctgaggcacgagaatcacttgaacccaggaggcagaggctgcagtgagccgagactgtcccactatactccagcctgggtgacagagtgagacactgtctcacaaaatacaaagcttgtaaaagttttcaggtcaatgccctcaactctggcaggcagcctttaccccacaccatcaacttacagttgtatgagtgaaaccaagggaaccccaacctggctgtgccccaggacctgggtagatctgcctggcgtggaaggctgtgcccaggacttgttgctgagaatgtttcttagaagttgggtgactcaggctgggcccggcggctcatgcctttaatcccagcactttgggaggccaaggcaggcggatcactcaaggccaggagtgtgagaccagcctggccaacatggcataaccccacctctactaaaaatacaaaaattagccaggcacggtggtgcacgtctgcggtcccagctactcgggaggctgaggcaggagaatagcttgaacccaggaggcggaggttgcggtgagccgagattgcgccactgcactccagcctgggcaacggagtgagtctctgtctcaaaaaaaaaatgttgaagaaatttttcattctctacagttgcctttaaccacttgcctgttgtatttggggctgctctccccatccacaccaaccacctcccaccaatttgcggtttatctttttggatctgtggacttttcggccccattttggccaagtgctccatgatgagtttctggcctcaggaccgtgaacactctcttgcccagggctgggagtcggggtgagccggtggtcaggctccactgagagggccttggtgtccacacagggctggggtctcctggatacaatggagcagatgagccgggaggacatgctggccatctcaacacccgtcttgaccagtctggtgagacaagaggcaggagggaggaagctagggcaggagggaggaagctagtgggtatcccatccaacagcacagtctctgcccctaccttccgacacccacagctacccacctaccaccaagccccctttgtctaactgatcaattttacttccactccggaatctccttagatatgagccagtgtggttctcaaaggaaaaccatcatcaccatcatcgtcaacatgaaactgcccgttaatgagcacatattacgtgccagggactatggtgcactgagcgccgggagagggtttcatctccttcaatcctcactgcaactctgttttcttttcttttcttttctttgtttttttttttttttttgagacagagtcttgctctgtcgccaaggctggagtgcagtggcccgatctcggctcaccgcaacatccacctccctcattcaagcgattctcctgcctcagcctcccgagtagctgggattacaggcccctgccaccatgcccggctaatttttgtgttttagtagagacagggtttcaccatgttggccaggctggtctcaaactcctgacctcaggtgattcacccgcctcggcctcccaaagtgctgggattgcgagcgtggagccaccgcgcccggcgctgcaactctttacagaggaattctcgctagccccattttacacatgaggaaactgaggcttgaggtgtcatgctggggaaggggcagaggcagagtttaagccagttttgtctgaccctagagcctcagctgtcagatgtggagctagatagacctggggccaaatcccagccctgggcacttgcccagttatcctatcccctctaagcccatctcttcatctacacatggggatgacactgcccactcgcctgggctgttgtaaggagactagacgttgcatttgaagagtctacctgggatctcaataccaggggctgttcaatctttgtccatttcccttctttggaagccccagaacccttcccattcacgcaatctcatcactgccctctggagctgaggggagcccctatcatttctgctctcacttacttcccagttaacttcaaccgagcacctgcttccaggccagaccctttgctggggacttcacataggctgccaggcagagactgactttcagagaggtttagccacctgtctgcgatcacacagccaagcagtggttgcagagctaagatctgactccaaacctgagcttatgccaaactcccagggaggcagagaggcagctggctgtcccctggaccatcagcctgggatttgagggaagctatgctggagagtttggggcttcctgggatggtctgccacatctgtgcaccctgagcagggctgagcctggcctcttgccccaggatgtgccccctgagatgatgcccaccgtcatagatgaatacctaggaagcaactcggacgcacaagccaaatgccaggcgttccaggaattcatgggtgacgtattcatcaatgttcccaccgtcagtttttcaagataccttcgaggtaagcctgtccctggccacctgcccaacccctcccacttgggcccaggagctgggtcatcacaggtgacatggcatgatagggtgctggttccctcaatgccttgcaccccacaccccactgccccccaccaaacctatctttctctgggatgcagtgtcatagtaatgagaggtatctccagcaggaaactatgcagaggagaaaacctcagactcagagaggtacaatgactcaccaaaggtcacccagcagggcctatcactaattctcagggattcactcaaatgggtgatttcatcctctttcagcacttctggggggaaagtcttgcttccttcaagcctagtagctaatccctgatgcagacccagaacagttccagacccagaactttgtgaccttgggcaagatacctaccccctctgagcctcagtttcctcctttgtaaaatggaaataataatagaatctaatctattaattctattaatacagaatctattgtgatggggattcaataaatgatgacactggccaggcgcggtgggtggctcaatcttgtgatcccagtactttgggagaagcgggaggatcgcttgagcccaggagttcaagaccagcctgggcaacatattgaccccaatctctacacaaattttttgaaaattagccgggcatggtggtacacacctgtagtcccagatacttgggaagctgaagtgggaagatcacttgagcgcgggagtctcaggctgcagtgagctgtgatcatgccactgcactccagcctggtcgacagcaagaccatttcagagattaaaataaaaatattaaattaaattaaaatgatgacacaaagcacacagaatggtgcctgtcacctagcaagcgctcagtaaatgtttgcagctagtcattttatcatcatcatcatcatcatcatggaaattggtgttattatgagcatgtgctgccaaaggcagcatcgaatcaggccatgagtgcctaactcccatcccatcctttctctgtagattctggaagccctgtctttttctatgagttccagcatcgacccagttcttttgcgaagatcaaacctgcctgggtgaaggctgatcatggggccgagggtgcttttgtgttcggaggtcccttcctcatggacgagagctcccgcctgggtgaggacagacagacagacatgtgatccctaggctgccagactccaaggggcctgggcagggcttgcaggaacacgggtctccagtcagcactgaggatccttgggtcccttccaggtcccacctgactctcgttcagttctgtccctctcacctttccagcctttccagaggccacagaggaggagaagcagctaagcctcaccatgatggcccagtggacccactttgcccggacagggtgagtgagtgacagggcatagctcgctttgggcctgggatgctcaggtcggcccctctgggggacagcacaggaagccttggtcctcattcattcctcccacccagggaccccaatagcaaggctctgcctccttggccccaattcaaccaggcggaacaatatctggagatcaacccagtgccacgggccggacagaagttcagggaggcctggatgcagttctggtcagagacgctccccagcaagatacaacagtggcaccagaagcagaagaacaggaaggcccaggaggacctctgaggccaggcctgaaccttcttggctggggcaaaccactcttcaagtggtggcagagtcccagcacggcagcccgcctctccccctgctgagactttaatctccaccagcccttaaagtgtcggccgctctgtgactggagttatgctcttttgaaatgtcacaaggccgcctcccacctctggggcattgtacaagttcttccctctccctgaagtgcctttcctgctttcttcgtggtaggttctagcacattcctctagcttcctggaggactcactcccccaggaagccttccctgccttctctgggctgtgcggccccgagtctgcgtccattagagcacagtccacccgaggctagcaccgtgtctgtgtctgtctccccctcagaggagctctctcaaaatggggattagcctaaccccactctgtcacccacaccaggatcgggtgggacctggagctagggggtgtttgctgagtgagtgagtgaaacacagaatatgggaatggcagctgctgaacttgaacccagagccttcaggtgccaaagccatactcaggcccccaccgacattgtccaccctggccagaagggtgcatgccaatggcagagacctgggatgggagaagtcctggggcgccaggggatccagcctagagcagaccttagcccctgactaaggcctcagactagggcgggaggggtctcctcctctctgctgcccagtcctggcccctgcacaagacaacagaatccatcagggccatgagtgtcacccagacctgaccctcaccaattccagccctgaccctcaggacgctggatgccagctcccagccccagtgccgggtcctccctcccttcctggcttggggagaccagtttctggggagcttccaagagcacccaccaagacacagcaggacaggccaggggagggcatctggaccagggcatccgtcgggctattgtcacagagaaaagaagagacccacccactcgggctgcaaaaggtgaaaagcaccaagaggttttcagatggaagtgagaggtgacagtgtgctggcagccctcacagccctcgcttgctctccctgccgcctctgcctgggctcccactttggcagcacttgaggagcccttcaacccgccgctgcactgtaggagcccctttctgggctggccaaggccggagccagctccctcagcttgcggggaggtgcggagggagaggggcgggcaggaaccggggctgcgcgcagcgcttgcgggccagagtgagttccgggtgggcgtgggctcggcggggccccactcagagcagctggccggccccaggcagtgagggccttagcacctgggccagcagctgctgtgctcgatttctcgctgggccttagctgcctccccgcggggcagggctcgggacctgcagccctccatgcctgaccctccccccaccccccgtgggctcctgtgcggccggagcctccccaaggagcgccgccccctgctccacagcgcccagtcccatcgaccacccaagggctgaggagtgcgggtgcacagcgcgggactggcaggcagctccacctgctgccccagtgctggatccactgggtgaagccagctgggctcctgagtctggtggggacttggagaacctttatgtctagctaagggattgtaaatacaccgatgggcactctgtatctagctcaaggtttgtaaacacaccaatcagcaccctgtgtctagctcagtgtttgtgaatgcaccaatccacactctgtatctggctactctggtggggacttggagaacctttgtgtccacactctgtatctagctaatctagtggggatgtggagaacctttgtgtctagctcagggatcgtaaacgcaccaatcagcaccctgtcaaaacagaccacttgactctctgtaaaatggaccaatcagcaggatgtgggtggggcgagacaagagaataaaagcaggctgcctgagccagcagtgacaacccccctcgggtcccctcccacgccgtggaagctttgttctttcgctctttgcaataaatcttgctactgcccactcttt

SEQ ID NO: 13446 - DNA, 125 bp, Homo sapiens
tttttttgtatttttagtagagacagggtttcaccatgttggccaggctggtcttgaactcctgacttcagatgatccacccacctcggcctcccaaagtgctgggattacaggcgtgagccacc

SEQ ID NO: 13447 - DNA, 807 bp, Homo sapiens
ataacataagttgcttctctcacatggtcttaatagccatgaattagttttgttttaggtaaaagtttttctgaaaattttccacagctttgttcaaaggattctttttgtctctgacctacttttaatgtctgcattttttttggaaattcagagtcatagaactcttctctgtgtgtaaaagcattcagacagagctgctgcccatccttgcaacagctaggggctgaactcctgctctgctgagttttgggtttattctctaacctgtggcaatgtgctgtagtcagcccgacttatgctactgtcatggacagtgctaataataatactgccttttgctggagatgttagttctcacttatgcattttaagaccttttgctggaagtgttagttcttgcttatctaattttaaacgaatatgaaagacaatttaagtgattttgtacattttaatttactcatctacattttcttgtattttttggattaaagtgtacctgtatgctctttctttctgtggaacacttcatttgtagtgtccaatttttaaaaagaaaacattttgataacagtttcagagtaatgacaaaccaaacacacattctaattgtctacttgtacaatttgttgggtaggtactatagggggaagaattaaatatacatgaggaagagaaaaaatctttgccaagaatttcagttattatcacttatggtttacccatattgtcataaaagtaagaaaatgggaattctaattttctgtcacaaaataaagattatataaaaataatagtgttatt

SEQ ID NO: 13448 - DNA, 5616 bp, Homo sapiens
ctatgcagcctttcaggaagatagctctggagatgaggcagaaagtccttctaaaatgaagaggtccaagggaatccatgttttcaagaagcccagcttttctaaaaagaaggaaaaggattttaaaataaaagagaaacccaaagaagaaaagcataaagaagaaaagcacaaagaagaaaaacataaagagaagaagtcaaaagacttgacagcagctgatgttgttaaacagtggaaggaaaagaagaaaaagaaaaagccaattcaggagccagaggtgcctcagattgatgttccaaatctcaaacccatttttggaattcctttggctgatgcagtagagaggaccatgatgtatgatggcattcggctgccagccgttttccgtgaatgtatagattacgtagagaagtatggcatgaagtgtgaaggcatctacagagtatcaggtactgggaatgtgcacttcacttgatggtttttaataataacttcagtttcatttttcgaaggaagaaaaattattgtgaggaaaatttggcctggatcctaagccttattcatttccttgatcctaccagttgcacaaaaatccacccctctccccagcctttctttggtgttctggcatttgtttttttaatatttccttccattaggaggatttcacgttagttgttcatagcttgcagcagccaggactaaaacaaagtgaagtatactggcagcattgcttaacagggctgcattcagaccctgcttttttttttcttttgtttgtttgtttttttgagacagagtctcgctctgttgcccaggctggagtgcagtggcgtgatctcggcttactgcaacctctgcctcctgggttcaagcgattcccctgcctcaggctcctgagtagctgggattacaggcgcctgccgccacacccagctaatttttgtatttttagtagaggcagggtttcaccatgttggtcaggctggtctcgaacccctgacctcagatgatctgccctcctcggcctcccaaagtgctgggattacaggagtgagccaccactcccaggcgcctgcttttttttttttttttttctttcctctctaagcagaggctcagtggtatgagggccatcagcaagaaaagaaaggttaactgtgtgaaggaagcttcttggccaagagacacgtttatggacacagtcatataatgcatttccttagctcagctaagaggcatgacatggttttggttttggttttcttggtgcgcggttcttagagttagtgcagtacccggtcaatacatggagtggtccaagcaagcttctgttccatctccctgctccagaaatcctagaacagatactacacccaactttagccaaaagaccaagaagcagtaaatgtttaggccccacatgtgaatgctttggtcagctacatgcaactattacgtatattagcaaaatggattttctatttatctttattccatatgtatacaaattaaatttcatacttggaaagaatgtgttttgattgggtatctaaatcaagcaatatgtatattatttaaaagtaaaaagatttcttagaaagcggtatgacttttataccaggataggatgaaagccctgacctgtagcagcatctgtgttccaaattattacattcccattattcagtgtcttggtacctcatcagtttctgtttagagatttgttttataaagttaattgttggctgaggcaggaggatcacttgaacccaggagtttgaggctgcagtgagccatgatcgtaccactgcactccagccagggcgagattgagaccttgtctcaaaaataataataataatacttgttggtcacaagtactttcatgatgagttgttaagtcatacacatgtggaatatatagagagatagacttagttttttcatttagttggttcatacgcaattctagaaggtagatttgatacttaagttttgctgagaaagggcagatatttttgataattgggaaaaccgttacataatccactagattacatgccattatttaagagtatttttggtaaaatgttacttttttatagaaaattaaataaattaggcattgaatttgagtttataactccttagtattatataaatatatttaaacaaatatttgatttttatgaataattggctaggcatggtagctcacgcctgtaatcccggcactttgggaagccgaggtgggcagatcacgaggtcaggagattgagaccatcctggccaacatggcgaatccctgtctgtactaaaatacaaaaaattagccaggagtggtggcgcacgcctgtagtcccagctgcttgggaggctgaggcaggagaatagcttgaacccgggaggcaggggttgcagtgagcaaagatcgcgccactgcactccagcctggcaacagagcaagattctgtctcaaaaaaaaaaaaaataaataaataataataataatatactgaattgagttttaaacatttaaacattaataacataagttgcttctctcacatggtcttaatagccatgaattagttttgttttaggtaaaagtttttctgaaaattttccacagctttgttcaaaggattctttttgtctctgacctacttttaatgtctgcattttttttggaaattcagagtcatagaactcttctctgtgtgtaaaagcattcagacagagctgctgcccatccttgcaacagctaggggctgaactcctgctctgctgagttttgggtttattctctaacctgtggcaatgtgctgtagtcagcccgacttatgctactgtcatggacagtgctaataataatactgccttttgctggagatgttagttctcacttatgcattttaagaccttttgctggaagtgttagttcttgcttatctaattttaaacgaatatgaaagacaatttaagtgattttgtacattttaatttactcatctacattttcttgtattttttggattaaagtgtacctgtatgctctttctttctgtggaacacttcatttgtagtgtccaatttttaaaaagaaaacattttgataacagtttcagagtaatgacaaaccaaacacacattctaattgtctacttgtacaatttgttgggtaggtactatagggggaagaattaaatatacatgaggaagagaaaaaatctttgccaagaatttcagttattatcacttatggtttacccatattgtcataaaagtaagaaaatgggaattctaattttctgtcacaaaataaagattatataaaaataatagtgttatttttgtgttttgttattgattttattttatcaatactggataagttacagatttatcataatgccattaaaagattttcacaaaggataaggaatgccaaagtccagatgtaaggaaccactgtgaagtgctgttcagcttagactgcatttacccacagaaactatcagcgttaatttgtagcttgtttcacataattggctgaaagtgttaagtattaaaaacagcaaaaaactactttgtgttcttctgagcaatcgccactaaattacgtcacttaatgcagattgtactaaagacttaaaatcttatgtaatgtttgcaaatcatttgctttagtttccttttgttcaataagcaaaacgattttagaaacccatactttattttttttgttccagctctgttcagattaaggttatacttaaaataatccaaactttaaaatagaaattagatggggatgatttaatggagaataattttcaaagtgtttgtttgggtagctaattcaccctttgcaattacagtacaatatttacacataaaaaagtaatttacccacaactttttggaacatacttaggtacaccaagccacatttttttgtggtcagtcttgtgacttgttagaaaaagcagctggctgcctgtgtagagccagacttacacttggattgtagtttaatttttgtctttttacctttttttttatttttttgagacagagtttcacttttcacccaggctggaatacagtagtgtgacctcggctcactgcaacctccacctcctgggttcaagcgattctcctgcctcagcctcctgagtagctgggagtacaggcacccgccacaatgcccagctaatttttgtatttttagtagagacagggtttcaccatgttggccaggctggtcttgaactccctacctcaggtgatccacctacctcggcctcccaaagtactgggattacaggtgtgcgccactgtgtaatgtttttacattaaaaacaaattcctgaattaatgggcatatttgcttaatatatccatggttgctttgacttctgactgttgagcttttcaattatcatttaacttttggttaaattcacttttgaagttagttttttgggtttgttttttgttttttgtttttagatggagtcttgctctgtcacccaagctgaagtgcagtggtgtgatctcggctcactgcaacctctgcctcccaggttcaagtgattctcctgcctcagcctcccaagtagctgggattacaggcgcacaccaccacgcctggctaatttttgtatttttagtagagacaggtttttgccatgttagccaggctggtgttggactcctgacctcaaataatcctcctgccttggcctcccaaagtgctgggattacaggtgtgatccatggtgcctggcctgtttttaattattttttttattttttgagacagtgtcttactctgttgcccaggctggagtccagtggtgcaattatggctcactgcagactcaacctcccaggatcaagtgatcctcccaactcagcctcccaaagaacttggaccacaggcgcacgccaccatgcccagctaatttttgtattttttgtagagataggttttgaccatgttgtccagctagtctcgaattcctgggctcaagctatctgcccgcctcagccttccaaagtgctgggattatgggtgtgagccactgcgcccagccaagtgtagtcttacatgttagtgtttacagaggaactgtacgacctttgtgcagataaatatttcataacaagaggttcgttattggtcaggttgctgttctcatctccttagcaagggtggggataatggtaaagaaaacttgtgtgtttgattttcttttctcagtatcttctctcttctgaatttgaatgttttaaggaattaaatcaaaggtggatgagctaaaagcagcctatgaccgggaggagtctacaaacttggaagactatgagcctaacactgtagccagtttgctgaagcagtatttgcgagaccttccagagaatttgcttaccaaagagcttatgcccagatttgaagaggcttgtgggaggaccacggagactgagaaagtgcaggaattccagcgtttactcaaagaactgccagaatgtaactatcttctgatttcttggctcattgtgcacatggaccatgtcattgcaaaggaactggaaacaaaaatg

SEQ ID NO: 13449 - DNA, 25128 bp, Homo sapiens
acaggtgtaatggataggtaacagagaagacctcgtcccttcctagtcagggcatcagcatgactgagtgcttcctgccccccaccagcagccccagtgaacaccgcagggtggagcatggcagcgggcttacccggacccccagctctgaagagatcagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagaggagtaagtgccattttttcctatgcctagatatttttattttattttattttactttattttattattattttttgggacagagtcttgctctgttgcccaggttggagtgcagtagcacaatctcagctcactgcaacctccgcctcgaggttcaagcaattctcatgtcttagtctcccgaatagctgggactacaggcgtgcgccaccatgcccagctaatttttgtgtttttagtagagacagggttttgccgtgttggccaggctggtcttgaactcctgaccttaagtgatctacccacctcggcctcccacagtgctgggattacaggcgtgagccactatgcctgtcctagatatattttaaataaacttccactctaattacatgtaccagctgtcttctggaaacatgtgaaggcagagattcttgtttgacttttctgttctttatttttcagggtctcagtttttgtatattagagttgtattttgggatcttaatctcacaaataaaaatactgagtttccagaaatggaaaagttttctagcggatatttcctgaagtaataactcaaaatgatgtctagaaagatattaagctggccacagtggcttacgcctataatcccagcactttgggaggctgagatgggaggattgcttgaagtcagaagttcaagagcctgagaaacaaaaatttaaaccattagctgagcatggtgatgtgtgcctgtagtcacagccgcttaggagcctaggagattgaggctgcagtgagctatgcttgcaccactgtagtccagcctgggtgacagagtgagactctgtcctctcctccgctgacgccccacccaaaaaaaggtagatactggaattttccccttaaggcatcttacttttcttgggtaggtcgtgttcgctatttgggatacacttttttggaaccttcaataaagtagctatttatcttaagcaaataccatgatacattccatttgaggtcctattcagtagggaggatgaatcatttgagcgtggctttttagtatgttaaaagcaaataaagtgagttatgttaagtattccttattttgaacttcatgacattttaaattgatttgtttttgaagaattacacagagtacacaaattgtatacaacttgatgagtgggtatgcctgtgtaaccactacaaggatctggaaatagagcattatcaattttcttttgtgcctctttaaagggaatcacctacccctcccataagtaaacttcttttattgttgattgatgctgcctgattttaaacttacgcatacttctatttgtgtctagcttcttttacccaatattatatgttaaaagtaaaacttttagacaaactaaatttaatgggttttttttcttttgtgtttttattttgagacagagtcttgctctgttgctcaggctgtagtgcaatagtgtgatcacgggtcactgcaacctctgcctcccaggttcaagtgattctcctgcctcagcctcccaagtagctgggattacaggcacccgccaccatgcctggctaatttttgtatttttagtagagacagggtttcaccatgttggtgaggctggtctcaaactcttgacctcaagtgatctgcccacctcagcctcccaaagtgctgggattacaggtgtgagccaccctgccttgccagtttaacagagtttaattgagcaaagaacgattagggaatccagtagcccctaaaccagaatagatttagagcgactctggggctgccacatggtcacgtaatatttatggacggaaaatgtaaagtgacacacagaaaacagaagtgaggtacataaacagctggattggttatagcatggcattagccttatttgagcagtttgaacagttgcccccctgtgattggccaaaactctgtaattggtacaagagtagattacagtctgtgtacacatccagttaggttacagttccctatgttcggagaaacctttaggccaaacttaaaatacatgaggaggcagctttaacctaacatgtttgttagattgattcatgttattccatgtggcagtaatttgttcatctttgcactagatattgtttcattgcattatatgttagagtttattaatctcttctacttttgttgcttgtttgggtggttttcagtttttgactgttatgaatagtgcttctgtggtgtacatgtttttgtatttctgttatgtttatgcctgggagtggaattgctcatttgtaggccatgtgtatttcagcttcagtagatccctgcaaaacagtcttccagaatgcttgtaccagtttaccttctcaccagcaatgtatgaatattccacttgctaaagcatcatggtattttgtccttaagattcttgccattctggttggtgtggggtacatggtattttagttagagggtaacttaggaaatagctgttatcttttatataatagcttgcaaggtagctagctaaggaaaagaattaggagagttacagatattaaaaaaaacaacaacaaaaccaaactatgacaactctgacatggttggtaaagcaattgggcacatttgtcagtgtgtgaaaaaccagaggtttctgatgcagggaagtgggcccagtggatttggccaccatctaaagatgagggaatttctcagttcaatcctctacttaaaagagtctgcagttcctgctgcagtctccataaagaacttagcagctggtgacaggagagtgaagtgtcataggagaataactgaaacacataaacagtagtgcagttcgtcattctctgagattgcctaaagttataggctaggcagcacttagctggaaaagctagggtaggtaaagtgaacacaggttgagtatccctattccgaaaatccaaaatgctacaaaatctgaatctttttgagcactggcatgacacttggaggaaatgctcattggagcattttggatttcagattttttgggttagagatgttgaactggtataatgcaaatatccagaaaaatctgaaatttgaaacacttctggtctcaagtatttcagataagggatactcaacccgtagtatgttagaggacacgactcacgtgatgaaaggatgctcggtctactttagaaaaggattcattccattagccctctatgtagagcctttcaggtgtatctctaatgtttggtttgcctgaattccacttacacacatatgtaatataaaccctgtttcccctcctaatattgtaaggatggtaactgctatctatttgtccccctcttgtggtcaagagatgtcactgcaacatctctttttgagaagaaacccatttctttgctgggagtgcccaggaggaattggccaagaagtgaaaagctagattagctggtgccaggtggcaccgttttttggttctgtttttagaaagcatatggacagtttgacattaaacaaacatataacttatactgtctctgtttctttggcagctgaaggctatgcagcctttcaggaagatagctctggagatgaggcagaaagtccttctaaaatgaagaggtccaagggaatccatgttttcaagaagcccagcttttctaaaaagaaggaaaaggattttaaaataaaagagaaacccaaagaagaaaagcataaagaagaaaagcacaaagaagaaaaacataaagagaagaagtcaaaagacttgacagcagctgatgttgttaaacagtggaaggaaaagaagaaaaagaaaaagccaattcaggagccagaggtgcctcagattgatgttccaaatctcaaacccatttttggaattcctttggctgatgcagtagagaggaccatgatgtatgatggcattcggctgccagccgttttccgtgaatgtatagattacgtagagaagtatggcatgaagtgtgaaggcatctacagagtatcaggtactgggaatgtgcacttcacttgatggtttttaataataacttcagtttcatttttcgaaggaagaaaaattattgtgaggaaaatttggcctggatcctaagccttattcatttccttgatcctaccagttgcacaaaaatccacccctctccccagcctttctttggtgttctggcatttgtttttttaatatttccttccattaggaggatttcacgttagttgttcatagcttgcagcagccaggactaaaacaaagtgaagtatactggcagcattgcttaacagggctgcattcagaccctgcttttttttttcttttgtttgtttgtttttttgagacagagtctcgctctgttgcccaggctggagtgcagtggcgtgatctcggcttactgcaacctctgcctcctgggttcaagcgattcccctgcctcaggctcctgagtagctgggattacaggcgcctgccgccacacccagctaatttttgtatttttagtagaggcagggtttcaccatgttggtcaggctggtctcgaacccctgacctcagatgatctgccctcctcggcctcccaaagtgctgggattacaggagtgagccaccactcccaggcgcctgcttttttttttttttttttctttcctctctaagcagaggctcagtggtatgagggccatcagcaagaaaagaaaggttaactgtgtgaaggaagcttcttggccaagagacacgtttatggacacagtcatataatgcatttccttagctcagctaagaggcatgacatggttttggttttggttttcttggtgcgcggttcttagagttagtgcagtacccggtcaatacatggagtggtccaagcaagcttctgttccatctccctgctccagaaatcctagaacagatactacacccaactttagccaaaagaccaagaagcagtaaatgtttaggccccacatgtgaatgctttggtcagctacatgcaactattacgtatattagcaaaatggattttctatttatctttattccatatgtatacaaattaaatttcatacttggaaagaatgtgttttgattgggtatctaaatcaagcaatatgtatattatttaaaagtaaaaagatttcttagaaagcggtatgacttttataccaggataggatgaaagccctgacctgtagcagcatctgtgttccaaattattacattcccattattcagtgtcttggtacctcatcagtttctgtttagagatttgttttataaagttaattgttggctgaggcaggaggatcacttgaacccaggagtttgaggctgcagtgagccatgatcgtaccactgcactccagccagggcgagattgagaccttgtctcaaaaataataataataatacttgttggtcacaagtactttcatgatgagttgttaagtcatacacatgtggaatatatagagagatagacttagttttttcatttagttggttcatacgcaattctagaaggtagatttgatacttaagttttgctgagaaagggcagatatttttgataattgggaaaaccgttacataatccactagattacatgccattatttaagagtatttttggtaaaatgttacttttttatagaaaattaaataaattaggcattgaatttgagtttataactccttagtattatataaatatatttaaacaaatatttgatttttatgaataattggctaggcatggtagctcacgcctgtaatcccggcactttgggaagccgaggtgggcagatcacgaggtcaggagattgagaccatcctggccaacatggcgaatccctgtctgtactaaaatacaaaaaattagccaggagtggtggcgcacgcctgtagtcccagctgcttgggaggctgaggcaggagaatagcttgaacccgggaggcaggggttgcagtgagcaaagatcgcgccactgcactccagcctggcaacagagcaagattctgtctcaaaaaaaaaaaaaataaataaataataataataatatactgaattgagttttaaacatttaaacattaataacataagttgcttctctcacatggtcttaatagccatgaattagttttgttttaggtaaaagtttttctgaaaattttccacagctttgttcaaaggattctttttgtctctgacctacttttaatgtctgcattttttttggaaattcagagtcatagaactcttctctgtgtgtaaaagcattcagacagagctgctgcccatccttgcaacagctaggggctgaactcctgctctgctgagttttgggtttattctctaacctgtggcaatgtgctgtagtcagcccgacttatgctactgtcatggacagtgctaataataatactgccttttgctggagatgttagttctcacttatgcattttaagaccttttgctggaagtgttagttcttgcttatctaattttaaacgaatatgaaagacaatttaagtgattttgtacattttaatttactcatctacattttcttgtattttttggattaaagtgtacctgtatgctctttctttctgtggaacacttcatttgtagtgtccaatttttaaaaagaaaacattttgataacagtttcagagtaatgacaaaccaaacacacattctaattgtctacttgtacaatttgttgggtaggtactatagggggaagaattaaatatacatgaggaagagaaaaaatctttgccaagaatttcagttattatcacttatggtttacccatattgtcataaaagtaagaaaatgggaattctaattttctgtcacaaaataaagattatataaaaataatagtgttatttttgtgttttgttattgattttattttatcaatactggataagttacagatttatcataatgccattaaaagattttcacaaaggataaggaatgccaaagtccagatgtaaggaaccactgtgaagtgctgttcagcttagactgcatttacccacagaaactatcagcgttaatttgtagcttgtttcacataattggctgaaagtgttaagtattaaaaacagcaaaaaactactttgtgttcttctgagcaatcgccactaaattacgtcacttaatgcagattgtactaaagacttaaaatcttatgtaatgtttgcaaatcatttgctttagtttccttttgttcaataagcaaaacgattttagaaacccatactttattttttttgttccagctctgttcagattaaggttatacttaaaataatccaaactttaaaatagaaattagatggggatgatttaatggagaataattttcaaagtgtttgtttgggtagctaattcaccctttgcaattacagtacaatatttacacataaaaaagtaatttacccacaactttttggaacatacttaggtacaccaagccacatttttttgtggtcagtcttgtgacttgttagaaaaagcagctggctgcctgtgtagagccagacttacacttggattgtagtttaatttttgtctttttacctttttttttatttttttgagacagagtttcacttttcacccaggctggaatacagtagtgtgacctcggctcactgcaacctccacctcctgggttcaagcgattctcctgcctcagcctcctgagtagctgggagtacaggcacccgccacaatgcccagctaatttttgtatttttagtagagacagggtttcaccatgttggccaggctggtcttgaactccctacctcaggtgatccacctacctcggcctcccaaagtactgggattacaggtgtgcgccactgtgtaatgtttttacattaaaaacaaattcctgaattaatgggcatatttgcttaatatatccatggttgctttgacttctgactgttgagcttttcaattatcatttaacttttggttaaattcacttttgaagttagttttttgggtttgttttttgttttttgtttttagatggagtcttgctctgtcacccaagctgaagtgcagtggtgtgatctcggctcactgcaacctctgcctcccaggttcaagtgattctcctgcctcagcctcccaagtagctgggattacaggcgcacaccaccacgcctggctaatttttgtatttttagtagagacaggtttttgccatgttagccaggctggtgttggactcctgacctcaaataatcctcctgccttggcctcccaaagtgctgggattacaggtgtgatccatggtgcctggcctgtttttaattattttttttattttttgagacagtgtcttactctgttgcccaggctggagtccagtggtgcaattatggctcactgcagactcaacctcccaggatcaagtgatcctcccaactcagcctcccaaagaacttggaccacaggcgcacgccaccatgcccagctaatttttgtattttttgtagagataggttttgaccatgttgtccagctagtctcgaattcctgggctcaagctatctgcccgcctcagccttccaaagtgctgggattatgggtgtgagccactgcgcccagccaagtgtagtcttacatgttagtgtttacagaggaactgtacgacctttgtgcagataaatatttcataacaagaggttcgttattggtcaggttgctgttctcatctccttagcaagggtggggataatggtaaagaaaacttgtgtgtttgattttcttttctcagtatcttctctcttctgaatttgaatgttttaaggaattaaatcaaaggtggatgagctaaaagcagcctatgaccgggaggagtctacaaacttggaagactatgagcctaacactgtagccagtttgctgaagcagtatttgcgagaccttccagagaatttgcttaccaaagagcttatgcccagatttgaagaggcttgtgggaggaccacggagactgagaaagtgcaggaattccagcgtttactcaaagaactgccagaatgtaactatcttctgatttcttggctcattgtgcacatggaccatgtcattgcaaaggaactggaaacaaaaatgaatatacagaacatttctatagtgctcagcccaactgtgcaggtacatggtcttctctacacatataccctctggtactgacattggggaactggggtaattttctattgctgagtcacatgtaaagcagtgaacttgagaagataggtaatggattagcttgaatacgggtcttttcctttcataatttggacagtgtcaatgtataagataacatacttgccctttagcttgtagtgatgtaatttgaatgcggtacagtctttgatgtgggtttataaacaagacctgatgacaaggatccttcattaggggaggaggagcccatggcatctacagttacagagttcgtgtgtagaattttagagatcccagttatttaatcaatagcattattgcttcgttagatcacagacacacatcaaactcaggcacaaagggacctgtcattaattgtttggtcaaagatttagcctgaggatttcattcataaggatggatcctagagagacatgttataggctctgaatctgaaaaggaacttcagggaattgggtagtgtgttaattggtatctttttacgacatacatacttggctttcctttattgctgctcagttggtgctgtcatagagtatatgttttcttttaattgcagttaatgatattttactcaggccaataaaaagggagatgataggttatatttattatcttaagccctctttttggccagtattctgagtcaccataaatcactgtcactgttattagagagtgttttcatttactaaagagcgtttcagtcaggcgcggtggctcacacctttaatgcgagcactttaggaggctgtggcaggaggatagcgagaggccaggagttcagcctaggcaacatagcaagaccctgtctctacataaaaattaaaaattagctgggtgtggtagcatgtatgtgtagtcccagttacttcggaggctgaggtaggaggattgcttgagcccagcagtgagctatgatcatgccactgtactcctctctgggtgacagagcaagattttatctctaaaaaataaagattcttctgttactcattgattacgctttgaaagcaaaatgtttctcagattttagtttgatcattaggatttcaggatctggtaaatattacattgatacttaatattactataatataatagagatggttgtatcatagaagagtcaagtgtgttgtaagagtaagttttaggtaggaaataatttcttgtagtagcttttcagccaacctaatgccctggcctcctagcatatgaacatccatacttaaatgctggctgtgtccaggtatttgtttctggagtgagggctttcaacctcaacccagctttactactgtggtgctcccacttccctcatggtcctcattcattccattgcgtctgttaaaatatgtcaaagtaagttgaaaataaagaatataagatgttttagccgggcatggtggctcacgcctgtaatcgcagcactttgggaggctgaggtgggtagatcatttgaggtcagcagttcgagaccagcctggccaacatggtgaaactccgtctctactgaaaatacaaaaaaatcagccaggtatggtggcacacgcctgtaatcccagcttaccggggaggctgaggcaggaaaatcgcttgaacccgtgaggtggaggttgcagtgagctgagattgtgccactgcactctagcctgggctacagagcgaggctccatctcaaaaaagcaccaccaccgccaccaacaacaaaaaacacacaaaaaataagatgtttaaatcagttaatactgtgatagaaaaaataaacaaatggatggcatcaacttctctatccttttcttgactttttttcccttcagatctttctggtgcttgaatacatgatttaactcatattttaccattttcttcttaaattggctattaactagcaaagactgtgttgtcattactgggtagaattttctttatgtgtccaggattaaaggatatattatgtaatagacacaaataagtgaaatagaatgatagttttaatggttttcttgtaaatctttttttcttagatcagcaatcgagtcctgtatgtgtttttcacacatgtgcaagaactctttggaaatgtggtactaaagcaagtgatgaaacctctgcgatggtctaacatggccacgatgcccacgctgccagagacccaggcgggcatcaaggaggagatcaggagacaggtgtgtgcaccctgcctgccacagcctgcctctgcattggctgttgtggagtccagtggtgatgggctcttgtttcctgaacactttctgtgtgtctggagctatgttaggcacactgaagtcagaaattcccatctggtactgtttcatgccaaataagtcagaataccatggtggaaagagcatagtttttggaatcaaaacacctggctttaaattcttgctctgatctagttaactgattttaggcaaattcttaaccaccttaagcactggtgttcttgctttaaaatggatcctcttataggattgatgtgaagattaccccaaatgagataatatatgaaacatgccaggcacgttgtaaatagtctaaagatgtttgccttttcttgacaaggttgctgtcatcagccatattttatagataagaatattaaaattcagggaagttaagtaacttaccctgtgtgacatgattactaattacagacccaagatttgagcccaaatcctgggattttttactgtgctattttgatggaagtaacaatgccgtgtgtgtgtgtgtgtgtgtgtgtgtaattcaagactaaataagaaagttaattacatttgattatttatttgcatgcaatttatcaaacccctgcttgcttttcttcccttgtatctgccctgagctcccaatgcttactagttaatgatgatgacattggagatggggatgtggattaagtattattgaaccaatacaaattagtgaataattaataggcaaaacaataagaatgatttttcaatcatatcttcaaaaaaataattagtgccattattttactctaatgaaataaaggataattgaaaaatagttgattcttcatctttagaaattgcacgtgttgttagtttaagataagaggatatgaaatgcaactaggtgtgtggcatttgctttctaggagtttcttttgaattgtttacatcgagatctgcagggtgggataaaggatttgtctaaagaagaaagattatgggaagtacaaagaattttgacagccctcaaaagaaaactgagagaagctaaaagacaggtgagttattattttgatacctaatgtttataatagaatgtgtttgagtcttttatgtactttatgtactctttttttttctttctttcttttttcttttgatgttgaccagggtggtctcaaactcttggcctcaagtaatcctcccacctcggcctcccccagagtgctgggattacagacatgagccaccacccccagcccaagttctttctgttaagaatattataatgtcacttgaagtgaacttctctggtgggacatttattcactaaaatgtttctagtcctatattattgatattgcagcctggtgtcagtcacatgtttcagtgcaatctagaaagtttttttttttttttttttttttgagacaggatcttgctctgtcacccaggctggagtgcagtggcacgataatggctcactgtagcctcgacctcctgggctcaagggatcctcctacctcagcctcctgagtagctgggactacaggtgtgcgccaccatgctcggctcattttttattgtttgtagaaatagggtcttgttatgctgcccagactggtctcaaacttctgggctcaagcagtcctcccaccccccaaagtgctaggattataggcataagccaccatgcctggcctagaaagttttgttttaattaaaaatgattttactaaaaaatttgtcatttcctgcttggttatacctgtaaacagggctttctatggatgaaaaacaggctggatggtgacacacctttggggactgctggggaatttaaggcatttagaattagtcagctctttggaaatgtagtgatgagggtcacctggaaggccttgaagatcaggagagattctatttatgtaataataataagagtggcctgcaatacctgatgagtttagggtatgccagtcagacttttgagttccctcttgtttagtgtgtgttgcttggttctgggactgtgagtgtaccagccacagcaatggtaaaatcccagatctctggatcaccttaaaatccacattgcagatcaactgcagcatctaaacagcacatccaaggaacattagttagcccttgcctgaattggggaacatgatagtaggtctctgttgtggttgtgttaaagagacaaagacaacctgaatacttctgtttctttgaggttagagatttgtattaatgtggaggatagctttgtcacacggggcacattcatgggacttttacacgtgcgcttcaggatatgtaatgtagcagaagccctctgcgtatttttcttccttctttttcctagctcactaggttatctatctcttgcttcctttacgtgttttttgtttttggtgttggtgttgctgttaaaattttcccttcatgtctcagcctagaatcaggtattagagatggaccactcaggcttcaggggcaaattgtaattgttaatcatatggcattgccagtcagcctttaaatgaagagtcccctgactgacctaggacagggctgatggaggtttggcttttgtttctcttgcttctacatcttgcctaaataaaggaatcatggtatagcagccagaaccaatataagaagggatggattaactttgctttaccgattttcccgatgctatgttttcacgccagctcattaattcacaaaatgcacagaagattctacaaaagtctaatgtatttttatgtattagcaatgcacaattggatattgaacctaaaaaaaaagagacctaagtaaatggagagataaatcatggatgtggtacacaagattcaatattgttaagatgttagattttcacaaatttcaactttgaggaataaatgacttttaaagacagaagtaatgtaacttatcatattaacagactaaaaataagaaaaacccacaacatcgtatcagtagatgcagaagaagatttagtagaattcaatacttattcatgataaaattcccagcagataactttctcagcctgataaaggacatctacaaagaatctacaattatcatacttaatagtgaaagactaaatgcttaccctaagattggtgtacactgcagggatttctgctgttaccacctctattcagcattgtactggatgttctagccagtgcaataaagcaagaaaaaagacacacatattggagagaaataagtttttattcttggataacatgattatctgctgagaccagcttggtcggggagaccctaacccagtggcactagaggaattaaaagacacacatacagaaatatagaggtgtagagtgggaaatcaggggtctcacagccttcagagctgagagccacacacagaaatatagaggtgtggagtctcagccttcagagctgagagcctcttattgatagcaagccagtgataagcattgttcccatagattatagattaactaaaagtattccttatgggaaataaagggatgggccgaagtaaagggatgtgttctggctagttatctgcagcaggagcatgtccttaaggcacagatcgctcttgctattgtttgtggcttaggaacgcctttaagcagttttccaccctgggtgggccacatgttccttgctctcattccggtaaacccacaacctgccagcgtgggcatcatggccatcacgaacatgtcacagtgctgcagagattttgtttatggccagattctggggggcctattcccaacaattatctacatataaaatcctaaggaatctacaaaaaaagagctaatcagtgagtttagcaaggttgtaggatacaagaccagatatacaaatgtctagtgtatttctttatattagcaatgcacaattggatattgaacctaaaaaaaaaaataaaaagagagagacctaaataaatggagagagaaatcatgcatgtggaacagaagattcaataattgttaagatgttagattttcccagattggtctgtgggtccaaccccaatcaaaatccagacagatggtatttgtgaaaatgaataagctcttctaaaatttatgtggaaatacaaatgacctagaataggtaaacagttttgaaaaagaacatagccggaagattggaggactcatactacccgatttcaagacttactacaaagctgcagttcatcaagatggtatgtactggatagggataacatacagaagagaaagttcagaagttgacctacacatatatgggcaattactttttttttttttttttgagacggagtctcgccctgttgcccaggctggagtgcagtggcgcaatctcagctcactgcaagctccgcccgctgggttcacaccattctcctgcctcagcctcccgagtagctgggaatacaggcgtccgccactacgcccggctaattttttgtatatttagtagagacggggtttcaccgtgttagccaggatggtctcgatctcctgacctcatgatccacctgcctcggcctcccaaagtgctgggattacaggcgtgagccactgcgcccggcgggcaattactttttaatgaagatactaaaataattcagtggggaagggatattcttttcaacaaacagcgctggaacagatgcaaagaaaaaaactttatctgtacaacatatgcaaaaaatagcttgaaatgaatcataaactaagactaaaaaagcttccagaagaaaaaaaaaacaggaaaatatcttactgtccttggcttaggcagtaatttcctaaataggatacaaaacctattataaactataaaagaaaaatttgataaattgaatttcatcaaaaatttaaaaatatgctcttcaacagatattaagaaaataaatatccaagccagaagctgcgacagaatatttgcaaaagcttgtatctgataaaggacttgattttttttttaaagtttacagtttaataagaaaacaaccaatttttaaaaggcaaaaatttgaacaaatactttaccaaagatcatatatagatgacaagcacatgcaaagactctcaccatcattagtcattaaggaaatccagattaaaagtactctgagataacagtatacatcaactagaataggttgctcttggtaatgcaaaatggtgtagccattttgaaaaacagcttggcagtttcttattaagctaaacatgcggttacttaccatagcacccaggcttcccactcctaagtatttctctaagagaagaaagcatttgccctcacaaagcatgtgcgaaatgttcctaacagctctagttgtaatagcttacaactagaaggaaccccaatgtccatcagttggtaaatggataaacaaattggggtacatttattccatggcatgttgctcagcaactactgatacagacagacaagtagatgaatcttaaaagcattgtgctaagtggaagaagccagataatcacactacttactgattgattcagttatgaaactcaaggaaaggaaaaactgcagcgatggagaccaggacgggttgctagataccggcagatggtggaggagcccaagggcactttgtgtggcaatggaaacgttctagagcatgatggtggtgctggttacttgactttatgtttgtgaacactaaattctgtgctcaagatttacactcctgaccacaccctccctaagtattacaataggtaatttctgtggaagggtaccagaaatggcaagtacattcaccagaattgagtatttttcacagtgcaggcacagactcagatctccatgttatattccaagcccagttaccaaatgcccatccagctagatggttcatctgactgttattgtttcaattctaggaaatgagaaggaaacgtgtagattggtggtggtgtgatttgttgaatatgtgttacatatgggctgactagttcttttttatttgtcttatttgacaggagtgtgaaaccaagattgcacaagagatagccagtctttcaaaagaggatgtttccaaagaagagatgaatgaaaatgaagaagttataaatattctccttgctcaggtaacctaaaatctttttctctcttttgcaagactcttttttgtttttgtttttgagacaaagtctcgctcttgtcccccaggctggagtgcgtcgaagcgatctcggctcactgcaacctgcaacctccgcctcccaggctcaagcgattctcctgcctcggccccctgaatagctgggattgcaggcacctgccaccacacccagctaatttttgtgtttttaatagagacggggtttcaccatgttggccaggctggtctagaactcctgacctcaggtgatccgcctgcctcagcctcccaaagtgctgggattaacaggcgtgagccaccgcgcccagcctgcaaggctcttaatggtcatttaaaaatagtaacttgagaagctctactacagatgtgaatattttaaccaaaattataaagtgattttgagggcctgtgtctgttttatttgtcccttcctttatgttgtgtttgttaaaatgttcagttatggcgaaagaaactaccttatattcagtaatgactctttactgggcattgttctagacgtttaatctcatttagtgtgcacacaggtccgaattataggtcttttccctaatttacagattagtggtacttgttccatattaatgagatcagacttttaaaaatattttaaaaaccgttgtacctgacattacaaagtctggaatccttgaaatgtaagaaacagattttatctaatagttgttgctaataacaccttttagatattttgattttattctttacaggtgaaagtcaattgttggaggcaaattgtcttattagtccttcattgatttaacagatatccctttcgtgcctactgtattccaggcatagagctgaagatgagctcatttctttctgaagttctcaagtcagcctcactttgttctggaaattgccagagtttaaccagaaaggaatgaagttctaggctctgaccacagtgtgtctagggttccagaaactcgtgtggtttccctgaagcccaataggtttcagtccttctgtgtcacctctgaaacatgcgttgttttgcctctcaggagcacatagttttccttgaggagaggatgagtcccagattatatctttgtttcagggtttttcagtctggtgtttgttggaatgtcagctttagtaggtatgcagaggtataggaaagacatctgtgttcaaaaatatttgagcagtactgtgtccttcatctcctggagagacgttctcagcgctgttggtgtttgtgggtagttcattttggcatgtgaccatggtaaataactaccttctcagtacctgctcatttggaaagaacgtccgcacccagctcctcatccccacagccaccttctgttactctcttaagctttgtctgccttgcttcttttctctaggtcagaggggctctctagatcttgggcagatagggattttttccccattcttttaataagactgatgatcttaccaatcttagaaatgcatattgtggtaaagcagaatattgactatttaaatacctttgggccaggcatggtggctcacgtctgtaatcccagcactttgggaggctgaggcgggcggatcacctgaggtcaggagtttgagaccagcctggccaacatagtgaaaccctgtctctactaaaaatacaaaaattagccaggcgtgatggcaggcgcctgtaatcccagctactcagcggctgaggcaggagaatcacttgcacccaggaggcagaagttggagtgagcgagattgtgccactgcactccagcctgggtgacagagtgagactctgtctcaaaaaaaaaaaaaacaaccctgaggactttaaagaggacggtggcttatggaaaggtgaaaaaatttctgtaatgatctttccttcccactgatctgccttaaaggtgatgctgacaccagccagacatctcttggatccttcttttcctagtgaccccatcaaaggtcaccatggccctgtatatgcctactttcctgagagatggggaggcattaagagtgggaagccgaagccagtttcatccctcaagtcctggcttttccctgtgggggcctcacaggggcctttgcagtaggaggatatggggttcctgtgtggcattttgttattgagaaaaatctagtcattcccccaaaataactttaccttttctcaaagaagccttttcttgaccctaatgaaataggatgtttttggttgtgcagtacgtaactcgtgttcagcactcaatggggctcaagaattcagggcaacatgggagaccctaaacaagtgacatttcctggactaaaactctcagagctgttcaccagtgttcattatttcaggagaatgagatcctgactgaacaggaggagctcctggccatggagcagtttctgcgccggcagattgcctcagaaaaagaagagattgaacgcctcagagctgagattgctgaaattcagaggtaaaggaaagccgagggttttgaagcttctgagcatgtttctttaaatataaccataattgttttagctctcagactttcctacaaaagaattaggcatgtgaaattcatcatctttaagtttcttatttatcaggtcctaagaatggtgttatattgagtagagtcctgaaaacgtggtaaatataaaaggaggtcacagacaagcacatccagtagcgtcttcctttgtctctcatcttgcagtcgccagcagcacggccgaagtgagactgaggagtactcctccgagagcgagagcgagagtgaggatgaggaggagctgcagatcattctggaagacttacagagacagaacgaagagctggaagtgagttttggggggaaatagccaaaatgcatactaacttttagaaagttgtagagaccacatatttcccctcagaattgtccttctttttcttggtcaccagctgggaggctgagtagagaggaatttagggggacatctcaccgagagtctgtgggacttgagctaagtgctggccaagcagatggcacctgtgtgtcttcctcaggctgtgaactggagttctgtgactttagtgtgacatgtagacctttctccacccgatgtaaaggcaagcctcacctgactgtgtcagcttgagcagctttgaatgacctagtctctgttcccagagaaggtgaacagaaaaatcagcgctagtgatggaagaacagtctcccgagtctccctgtgggtgaagcaagagacggagtttctcttggcctcagcccgagaagcagcaggtgagagggaatcggcgctaagaaactaggagaggctgcacagtgaagagaaggcagcagagataaaggtctagatcacagtttcccttcttaccccaaataaaatattgtgtccagatattttgcctaaggattgagtgagagaagataccctcttcacagaaaggaatctaaggatagagggacagctctgcatccctcatttgggttcgctcagtggctggtgcgaaccagaactacaccctgcatagaaaagcagaattccacacacagccaccctgcacagagtcctctctgccgagcctgcgggcagagctcagaggcaaccacgaaggttcaaggcagagacccttgctgcggcaggaatgtgctgtgggaggaagccctgcaggtgctgagaccagggttgctggagctcctgttcagaaaggcctcacattggcacctgatgttcttttcttaacattttaagatcgtattaaaactctgagtaggaaaacagaatccagaagtattgtacttggggtgtaggctgaattgctgtaataaagagaataacatagtggtttaaacaagatggtgtctcttgtgtggcaggcggtccagcccatcatcctccacaccacttttttccatgtagggtccaatgtggctgctctgtcttgccactcttagcaggactaagttagcagggaagggatcaaggcatgcccagtcgccaagggcagggtgcatgcgtggcactcggtgcttgcgcttacacctatgcccccttcgcagagcctagtccatgccacacccacgcaggggaggctggcacctgccacagagtggaggccacggcagcagggccgctgctattcctcaggacctaaactttgccgagtacatccagatgatttagaattgatagtaattttctgtagtttgattgagtaggacatttcagaattaccgtaatactattcacaaaagacaaaggatattcacctttgaaacaaatctagttttttatctgatctctaactcccctttctaattgctgctaaaattacttttattttctccttgtttaagggctgttgagaagccagttcaaagttataagttgtctattttaaacactaggatactgaattattaaaataacggttttctgttggcacatggatgtgtttctctctagtaaccaggagcagggtttccagcctcacattctcaggagtcacgtggctcactgtgcactgtgcattcctgctgtgtttgtcttctgtttcacaacccattgacttaaacaaaaccagattcctctgtaggatgcccttgctaaccgcgctctgctcctgagaaatcgtcctctgacttccttaagtgataactgccctttctgtcattccccaagataaagaacaatcatttgaatcaagcaattcatgaggagcgcgaggccatcatcgagctgcgcgtgcagctgcggctgctccagatgcagcgagccaaggccgagcagcaggcgcaggaggacgaggagcctgagtggcgcgggggtgccgtccagccgcccagagacggcgtccttgagccaaaagcagctaaagagcagccaaaggcaggcaaggagccggcaaagccatcgcccagcagggataggaaggagacgtccatctgagcagcctgcgtggccgtctggagtccgtgagactgaaaggacccgtgcatcttactgtaacccgggggccaggccggctctctcgctgtacattctgtaaaggtgtcttctcttctcagactcttcctctgtcacacgtctgactccttcacgtcaggctcaggttccatgggaggacgaagcagtggacgcattgtgggctttagggacagatgagttttccagatagtgtcagcttatttgaagattaattttctttgttaacttaaaataactattttaacccttgagtggcttctttttaaaccaaaaatcgtctttctttgcttttttatcacagcagaatcaggatctctttctcattcaaggggggaaccacaccaggtcagcgctgcgcctgctgtggccgccgcgagccacgccctctgggatctctggtaccgtcactcttgcttgtgccttccacaccttctcggtgcagatccctatgggggagctgcctcacgttctctgactggtcagagcagcgcctggtgggtgttccctggcccactctcctctctccttctgcagttctaaaccacagtctataagcccgagtcaccaggacggcctgtctggccacagacaggggctgcctgtggagcctgcccaccggcccccggcagtgcagtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctgtgattcaccccaccccattttcttgtttctggtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaagaaaagcttctagtttttttgtacacattctttctgtgaggagattgagtactctgcagctggcgaggagttggttgaggcacttcttcaaggccaagggggaacacagtgttttgtttccagctcactttgtacccctcacctctgcagacacggggagaaccccggacccctggcatgcatgctggcggcggcatgcctcccttccacaagcccatgctgctgcagagggagcctgtgtttgcaaaacccagtggactgggctgggtctgctgtctgagcagctcctggctccggtgggaactgcacacaagtccactggcctggcttggccccaggcattgcaattgacagacatttgcatttcatacggtaaatgaggactcagcacagccaaccataatcagcatgtctgggatagactggtctagaataaaaatgaagtttccattgctttgtttgctttaaaaattccacaattaaaatatctgtcattgaaagcttagacaaa

SEQ ID NO: 13450 - DNA, 111 bp, Homo sapiens
agatggagtcttgctctgtcacccaagctgaagtgcagtggtgtgatctcggctcactgcaacctctgcctcccaggttcaagtgattctcctgcctcagcctcccaagta

SEQ ID NO: 13451 - DNA, 551 bp, Homo sapiens
tttctttcctctctaagcagaggctcagtggtatgagggccatcagcaagaaaagaaaggttaactgtgtgaaggaagcttcttggccaagagacacgtttatggacacagtcatataatgcatttccttagctcagctaagaggcatgacatggttttggttttggttttcttggtgcgcggttcttagagttagtgcagtacccggtcaatacatggagtggtccaagcaagcttctgttccatctccctgctccagaaatcctagaacagatactacacccaactttagccaaaagaccaagaagcagtaaatgtttaggccccacatgtgaatgctttggtcagctacatgcaactattacgtatattagcaaaatggattttctatttatctttattccatatgtatacaaattaaatttcatacttggaaagaatgtgttttgattgggtatctaaatcaagcaatatgtatattatttaaaagtaaaaagatttcttagaaagcggtatgacttttataccaggataggatgaaagccctgacc

SEQ ID NO: 13452 - DNA, 395 bp, Homo sapiens
atgaatcattaaatatatcattttaattataaaatttaattatgatgtgaactgttcatatgtagttataaagtcgtctttgtaacttatttatagttgtttagtcataaagcaaaatagtaagattttatgttggggagcagtcaaaatgaagcactttagaatgatgagtggtttttttttttaaggaattccatattctactttgagaactctacctctgattttcatttgatttattttttgaatactcgaagatcccagtgctttcaaccctgagaactgaaatgtgtgatgcatggaatatatctcgagacaataaaatgaaagagttttttacaagggggtttgtggagaaaatatttttgatttgtaaatgctgtggtgtttttgtt

SEQ ID NO: 13453 - DNA, 7469 bp, Homo sapiens
tccaaggacaagagtgtctttactggagttgggactggggcctctataggggcttctggtttctgggctgtaggtttgtgaagtgtgggatcttaagtcaaaggtgggggactagggcagggtatcagaaggtgatgtcatcctcgtacagggacagcagcagcaggacggtccagccgcccagcaggcccacgttgtgcagcaggaagaggagccagggccgctggtcccgtactttcaacatcgccgggagctgaggagcaagtgggcaccgggtcagcgcccctgctcagctcctctgctcagctcccggcccagagcagcccctcccctcgccatcctgaccatgtcgcatagtgctacgtagaggaacaggccggtggccactgccaggatccaggcctcgctctcctcgctgactccaaccgcgagtgccacgtagagaccagcgaaggccgtgagcgcggaggccaggttcagcagcagtgcttggcgcacggacagccccgcgtgcagcaaggcggcgaagtcccctgcgggcgagtccacattaacagctccgccctcctagctacatgccccgcccacctcctttcggtcccgccctcttaccaccaggccccgcccacctgttcccggtctccccgcccagccgtcagatcccgcccatcaccttccaggccccgccccacctgtttccggtctccccacccagccaggtgcggccccgcccatcttccaggccccgcccacctgttccaggtctccccgcccagccccgtgcggccccgcccatctccttccaggccccgcctgcgctcacccagctcgtgtggcaactcgtggcagaacacggccagcgaggtggccagcccggtcttccaggaggacgcgaaggcggcgcccacggccagcccgtcggcgaagttgtgcacggcgtcgcccagagtgatcatatagggcagtagcctcaactctgcgggcgcagaggcccgtgggttcgcgtggcctgtcgcctaccgccaagccttgggccccacccgcgctccacacaaaccccagatcccccagcccttccggggtcgccccctgggctcacctgggctcagtctcctgggctcagggttcagcagctccgggctctcctccgccacctgggaggagccttgagtaagtcccgcccggaagtggaggaggaacgcggtggggcggggcggggccccagatcaccgcgggaggcggagccgcaggcctggggtggggctgggagtgtgggcgtgggaaggggtcggtgggaggggctccgcgcgggatggggcatctggcgcccactcaccaggtctgcgcgggagccctcgtgggggggcttgggctgccggagctcgctgggtgccagctgcagggacacaccgtggctgtggcccccgtggctatggctgctgtggccgcagggcccgtcctccaggtcctgtgagggtaggtgctcagtgtccaccaggcccccagcacacccacccgccgggtaccttcccaagaagcctgacctccgggtccctgggcagcaggagattgaagaggttctcaaacaggaagaaggcgtagagcccggccagcatagccaggaggcgccaggtgggctgtgggctgaggccctcttcgctgtgtgtatgcagccccaacacctggggagtaggggcgctgggctgggggggaggtcccatggtgcctcccaccaaaacccaaggagaggggtcaggaggtggggtgggtaaggtccctgggagggcatggcctgggagtccatggtggggaacggacggccatggtcgcgggtttgtgggggcacaccttgggcgtcagatgcacgacagcgtccccagtgagtgcacccactgccaggctcaggaaggtctgcaggatgtagtgggtgacccccctgcagccagtgcaggtcagcagcaggaggccaaagaccgcgcagaggcagatgagcagcgtggccagggagccgtacagataccctgggggcgggtgaggcggctgtgaaagcttttcttccagactcagcccctgcttcccgggcgctgctcaccaaagctgcaggccgtcagtgtgggccaggccctcactcaggctgaccctcctgcctcaaagccccactctcctggcgacgccaccttcccctgtgtctgttgtttctacttccagcccctgctcactctctccatccctcatcctgggcagccactccttccttcctacacgggctccacctctgtgctgccagcacaatgtcggcgtgggcactcactctctgactggctgagctggtcctggacggggggcctggactgggaggtgcaggctccactcagctgctgttggagcagggcagggctcagttgggcccaggcctccggggtcaccccagcctgttccgacagtccatatgcagccatcacgtccctggcactcaggcatacctggggggtggcaggacaggctcaggggcccaagcagaccccggtgaggccccatcttaccccagggcgcagctcaccgtgtcccacacactggagctgttgctggagctgatgaggggcacagggtcccagctgctggctcccctgtgccgatgactgtggtcactgtgggcctccctgcccacccccaggcgctgcatcaaggctgacagctctggcagggagaagagttggcaccgcgagtctgtgtgggttccggccctgccccccagggacgtggaggctggggaatcgggggtgcccccctccacagcccagcccaggcctcaccggccagcgtcatagggacctcgctgctgtgctgctggaacacaaagtccacgaagtactgagggctcggcaaggcgtggaagcaagacccgctcctgacatggtccagcagggcagccaggacgccgccagcactgcccggagcccccgcccccaccgcctcctccagcagctgagggatatctacgcaggcctggggaagagggggcctccgcctcagcctttggtgtgaccttctgccatccaccccgctgcccctggatgcatctcccaccccaactacaggatctgcccccaccagccccgcccctccctggagccacagccctccctgccgggcccagctgcttcaggctcccactcaggcctcagggttcctccctcatgaggtccctcccggggctcctacaggctcccaactgcccagtagtgagccccacgttgtgaatccccagccgcaggccgactcctgggcgtctccccaggcccccaggctccccgaaggctttgcagccaggccgggtcccatgggccgtgggaccctcctcacccactcccctggtctgcctggactctccctcaccgtcttgggggtctggccggcagcccgggcctgcatcctctgcagcagccagctcaggcccggggtcagggccttggggctctcgagcagggccaggaggtggtctgcatgagaggcccagaggccagcccgagcgtcctcacaggtgccctcggggttgctgaggtacaggacggcggcggcactgaggcgggcgacttacctggcctccaggaccgggcccgggggcagccctgacccctcaggctcgcccaggcccagggcgtcctccacagacaggcactgtgggcagagacaagtgagcaggggcgctgggcccaccaaggaggggagaggcaggcctggccaggggcttccccgagggcctgtttccctttcaagtccaacaacgtccaccatcctctctcaacccctggcgcccttccgtctccccaggcccctgtcctgcttccccaactacaggggtgcacgcagaggggtccccaacagtggtcccccatccccaggggactcccctggagccactgccaatttgatggcagagggccggcagggggagttggccctggggtcctggggagaagagggactgtgtccctggaaaggcctgtctgccctcatgagcaggagggtgggctctggcctgtggggagggtcatggtgcccaggtactgccactagcctcctccgcctcctggagtttgcccagggccctttgctgccggctggcagggcggaactggcgggaagaggccagggctgggggacccgtctggtggggctgttacctttccacacggcccgttggcgcagtgcacacggtccgccagcgtatttaacaggccgcccagagcctcttgatccagagcgccctggccagaggtgagcaggctcagcagaccagcaggcggggacgccgtcgccgtcaccaccagcacagccagaagcagccccagctccagcgagaccagggacgccatactcagctcccagcgtgctcagtgggtgttgctgtggccaaggcccagtgcttctgggctggctgagggcggctttgctggggttgtccagggccagactggggctgggctaggacccgcccgggctgcatgaggacctctcccaggtattcctgcaaagctctgtgattggctgctggagatgcctgggttaaccattccagtggcagatcctccccaacagcctggagccactgcctgtgggggtcgagggctgggccccttcccctggacaggcagcctcggtggtcttttttttttcgagttggagttttgctcttgctgcccaggctggagtgcaatggcgtgatcttggctcacggcaacctccgcctcccgggttcaagtgcttctcctgcctcagcctcccgagtagctgggattacaggcagcgccaccacgcccggttacttttgtatttttagtaaagacagtgtttctccatgttggtcaggctggtcttgaactcccaacctcaggtgattcgcccgccttggcctcccaaagtgctgggattaccggcgtggctcaccacgccaggccagcctgggtgggcttctgtcctctgcctgctgccccccaagctgtggggcagggctggggtgtccccttctggctgtccatctgggggctgcctccaagctgggggacacagggcagaggtgcacagatgcccccagagcctgagagctcccaggtccctgcctctgcccctcccaacagaggctgcccagacaccctcggtggcccctgttgggggtggggacatggacctccctcctcctgggtcctgggctgtggtccctgttggggactgcgatggagtcaaagaaactgaaaaggtgcctgctgcatcatgctcccttaggccggagacagccccaggaagctccaacacagacaaacaggaagacggagctgggccctggcagccacctggccgagcttgggtcaggataagattggggcaagaccccatctctagccccgggggcagggatgctgtggctcccagccctgccctctctgtgggctccctctctggcctttgagcctagaggccttatctctaccgtggtggtgatggcaggaagtctgggggaaggggaaggcacatctcagggcatctttgccttctgaagggggagtccagatgccacctcccgcccggtccagccagcctgaccctgatcattgtgggtggggctggggtggggagctgggtgcctgaggcccaaggactctgtcccgccatacacagggtgggacggggcagggcgggcattgagcccagtgtcctggggtcagggtgcttcccctgccggcctcaccccaccaagcggatctcatggtgctcctctggctgggcccacccgcagtggtatccttctgggggcccttaggggagcctgccgggggtgcagatcctgccgggggtgcagagcctgctgggggtgcagatgatttctgggtcccaggaccatgagggggctgctctacacacagcctgaagatgctgcggacccaaactggccctttccctcccacaccaccccaggaccaatgggctggctggaggccacccatgctaaaataggctcaagggcctactttagcttctgggcaaaggttttggcctgggcctgactctgtggccttcctgagctgcctccccagtaggcctcagtgctgggctacaggcctcctccattccctccattcatgtgaccccacccctcccagcagaaactctcttccgtagcccaggagcagctgttgagggtttcacctgcccatgccccagcctaaggccggcttccccagagcagacgggttgcactctcctgcccctcaggcccactctgtcatccaacaagctcactgcaactggcccatcttaaaaacaacaccggctggtcacgctggctcacacctgtaatcccagcgctgtgggaggccggggcggggggatcacttaaagtcaggagtttaagaccagcctgggcaacatggtgaaacccgagctccactaaaaacacaaaaacaaattaaggcaccctgagtggtggtgggtgcctgtagtcccagcgactcgggaggctgaggcagaattgcttgagcccaggaggtggaggttgcagtgagccacgatcgcatcacgcactccagcccgggcaacctggcaagaccctgactttaaaaagaaaaaaacaacaaaaaaaaaaagcccacgttcaatggcagcactattcaaaagatggaagcaactcaagtatccaaacgcgcatgagtgaacacatcgtggttcatccacagtggaacacgattcagccagaaaaaggaaggaaaccggcctgcaccgtgacttggatgcacctggaggagactgtgatgaacgaaagcagccagacgcaaaagggcaaggacggtgtgatctgactgatgtgaggaccccagccagtcaaattcatggagacagaaagtaaaagggttttgggaggccgaggcgggcagatcacctaaggtcaggacttcgagaccagcctagccaacatggtgaaaccccatctttactaaaaaatacaaaaattagccaggcatggtggcggggtcccagctgctcagaagtctgaggcgggagaattgcttgaaccccggaggcagaggttacagtgagctgagatcacgccattgcactctagcctaggcgacagagctagactctgtctcaaaaatagtaataacaaaaaattttaaaataaataaaaaaaatacaggccgggcacagtggctcatacctctaatcccagtactttgggaggccaaggcgggcggatcacctgaggttgggagtataagaccagcctggccaacatggtgaaaacctgtctactaaaaggtacaaaacttagctgggcatagtggcaggagcctgtaatcccagctactcaggaggcgaaggcgggagaactgcttgaacccggaaggcagaggttgcagtgagccgagatcgcaccatagcattccagcctgggcaacagaacgagactctgt

SEQ ID NO: 13454 - DNA, 7471 bp, Homo sapiens
  misc_feature (1719)..(1719): n equals a,t,g, or c
tccaaggacaagagtgtctttactggagttgggactggggcctctataggggcttctggtttctgggctgtaggtttgtgaggtgtgggatcttaagtcaaaggtgggggactagggcagggtatcagaaggtgatgtcatcctcgtacagggacagcagcagcaggacggtccagccgcccagcaggcccacgttgtgcagcaggaagaggagccagggccgcgggtcccgtactttcaacatcgccgggagctgaggagcaagtgggcaccgggtcagcgcccctgctcagctcctctgctcagctcccggcccagagcagcccctcccctcgccatcctgaccatgtcgcagagtgctacgtagaggaacaggccggtggccactgccaggatccaggcctcgctctcctcgctgactccaaccgcgagtgccacgtagagaccagcgaaggccgtgagcgcggaggccaggttcagcagcagtgcttggcgcacggacagccccgcgtgcagcaaggcggcgaagtcccctgcgggcgagtccacattaacagctccgccctcctagctacatgccccgcccacctcctttcggtcccgccctcttaccaccaggccccgcccacctgttcccggtctccccgcccagccgtcagatcccgcccatcaccttccaggccccgccccacctgtttccggtctccccacccagccaggtgcggccccgcccatcttccaggccccgcccacctgttccaggtctcccctcccagccccgtgcggccccgcccatctccttccaggccccgcctgcgctcacccagctcgtgtggcaactcgtggcagaacacggccagcgaggtggccagcccggtcttccaggaggacgcgaaggcggcgcccacggccagcccgtcggcgaagttgtgcacggcgtcgcccagagtgatcatatagggcagtagcctcaactctgcgggcgcagaggcccgtgggttcgcgtggcctgtcgcctaccgccaagccttgggccccacccgcgctccacacaaaccccagatcccccagcccttccggggtcgccccctgggctcacctgggctcagtctcctgggctcagggttcagcagctccgggctctcctccgccacctgggaggagccttgagtaagtcccgcccggaagtggaggaggaacgcggtggggcggggcggggccccagatcaccgcgggaggcggagccgcaggcctggggtggggctgggagtgtgggcgtgggaaggggtcggtgggaggggctccgcgtgggatggggcatctggcgcccactcaccaggtctgcgcgggagccctcgtgggggggcttgggctgccggagctcgctgggtgccagctgcagggacacaccgtggctgtggcccccgtggctatggctgctgtggccgcagggcccgtcctccaggtcctgtgagggtaggtgctcagtgtccaccaggcccccagcacacccacccgccgggtaccttcccaagaagcctgacctccgggtccctgggctgccggagattgaagaggttctcaaacaggaagaaggcgtagagcccggccagcatagccaggagggcgccaggtgggctgtgggctgaggccctcttcgctgtgtgtatgcagccccagcacctggggagtaggggcgctgggctgggggggaggtcncagggcgcctcccaccaagacccagggagaggggtcaggaggtggggtgggtaaggtccctgggagggcacggcctgggagtccatggtggggaacggagggccagggtcgcgggtttgtgggggcagaccttgggcgtcagatgcaggacagcgtccccagtgactgcacccactgccaggctcaggaaggtctgcaggatgtagtgggtgacccccctgcagccagtgcaggtcagcagcaggaggccaaagaccgcgcagaggcagatgagcagcgtggccagggagccgtacagataccctgggggcgggtgaggcggctgtgagagcttttcttccagactcagcccctgcttcccgggcgctgctcaccagagctgcaggccgtcagtgtgggccaggccctcactcaggctgaccctcctgcctcaaagccccactctcctggcgacgccaccttcccctgtgtctgttgtttctacttccagcccctgctcactctctccatccctcatcctgggcagccactccttccttcctacacgggctccacctctgtgctgccagcacaatgtcggcgtgggcactcactctctgactggctgagctggtcctggacggggggcctggactgggaggtgcaggctccactcagctgctgttggagcagggcagggctcagttgggcccaggcctccggggtcaccccagcctgttccgacagtccatatgcagccatcacgtccctggcactcaggcatacctggggggtggcaggacaggctcaggggcccaagcagaccccggtgaggccccatcttaccccagggcgcagctcaccgtgtcccacacactggagctgttgctggagctgatgaggggcacagggtcccggctgctggctcccctgtgccgatgactgtggtcactgtgggcctccctgcccacccccaggcgctgcatcaaggctgacagctctggcagggagaagagttggcaccgcgagtctgtgtgggctccggccctgccccccagggacgtggaggctggggactcgggggtgcccccctccacagcccagcccaggcctcaccggccagcgtcatagggacctcgctgctgtgctgctggaacacaaagtccacgaagtactgagggctcggcaaggcgtggaagcaagacccgctcctgacatggtccagcagggcagccaggacgccgccagcactgcccggagcccccgcccccaccgcctcctccagcagctgagggatatctacgcaggcctggggaagagggggcctccgcctcagcctttggtgtgaccttctgccatccaccccgctgcccctggatgcatctcccaccccaactacaggatctgcccccaccagccccgcccctccctggagccacagccctccctgccgggcccagctgcttcaggctcccactcaggcctctgggttcctccctcatgaggtccctcccggggctcctacaggctcccaactgcccagtagtgagccccacgttgtgaatccccagccgcaggccgactcctgggcgtctccccaggcccccaggctccccgaaggctttgcagccaggccgggtcccatgggccgtgggaccctcctcacccactcccctggtctgcctggactctccctcaccatcttgggggtctggccggcagcccgggcctgcatcctctgcagcagccagctcaggcccggggtcagggccttggggctctcgagcagggccaggaggtggtctgcatgagaggcccagaggccagcccgagcgtcctcacaggtgccctcggggttgctgaggtacaggacggcggcggcactgaggcgggcgacgtacctggcctccaggaccgggcccgggggcagccctgacccctcaggctcgcccaggcccagggcgtcctccacagacaggcactgtgggcagagacaagtgagcaggggcgctgggcccaccagggaggggagaggcaggcctggccaggggcttccccgagggcctgtttccctttcaagtccaacaacgtccaccatcctctctcaacccctggcgcccttccgtctccccaggcccctgtcctgcttccccaactacaggggtgcacgcagaggggtccccaacagtggtcccccatccccaggggactcccctggagccactgccaatttgatggcagagggccggcagggggagttggccctggggtcctggggagaagagggactgtgtccctggaaaggcctgtctgccctcatgagcaggagggtgggctctggcctgtggggagggtcagggtgcccaggtactgccactagcctcctccgcctcctggagtttgcccagggccctttgctgccggctggcagggcggagctggcgggaagaggccagggctgggggacccgtcgggtggggctgttacctttccacacggcccgttggcgcagtgcacacggtccgccagcgtatttaacaggccgcccagagcctcttgatccagagcgccctggccagaggtgagcaggctcagcagaccagcaggcggggacgccgtcgccgtcaccaccagcacagccagaagcagccccagctccagcgagaccagggacgccatactcagctcccagcgtgctcagtgggtgttgctgtggccaaggcccagtgcttctgggctggctgagggcggctttgctggggttgtccagggccagactggggctgggctaggacccgcccgggctgcatgaggacctctcccaggtattcctgcagagctctgtgattggctgctggagatgcctgggttaaccattccagtggcagatcctccccaacagcctggagccactgcctgtgggggtcgagggctgggccccttcccctggacaggcagcctcggtggtcttttttttttcgagttggagttttgctcttgctgcccaggctggagtgcaatggcgtgatcttggctcacggcaacctccgcctcccgggttcaagtgcttctcctgcctcagcctcccgagtagctgggattacaggcagcgccaccacgcccggttacttttgtatttttagtagagacagtgtttctccatgttggtcaggctggtcttgaactcccaacctcaggtgattcgcccgccttggcctcccaaagtgctgggattaccggcgtggctcaccacgccaggccagcctgggtgggcttctgtcctctgcctgctgccccccaagctgtggggcagggctggggtgtccccttctggctgtccatctgggggctgcctccaagctgggggacacagggcagaggtgcacagatgcccccagagcctgagagctcccaggtccctgcctctgcccctcccaacagaggctgcccagacaccctcggtggcccctgttgggggtggggacatggacctccctcctcctgggtcctgggctgtggtccctgttggggactgcgatggagtcaaagaaactgaaaaggtgcctgctgcatcatgctcccttaggccggagacagccccaggaagctccaacacagacaaacaggaagacggagctgggccctggcagccacctggccgagcttgggtcaggataagattggggcaagaccccagctctagccccgggggcagggaggctgtggctcccagccctgccctctctgtgggctccctctctggcctttgagcctagaggccttatctctaccgtggtggtgatggcaggaagtctgggggaaggggaaggcagatctcagggcagctttgccttctgaagggggagtccagatgccacctcccgcccggtccagccagcctgaccctgagcattgtgggtggggctggggtggggagctgggtgcctgaggcccaaggactctgtcccgccatacacagggtgggacggggcagggcgggcattgagcccagtgtcctggggtcagggtgcttcccctgccggcctcaccccaccaagcggatctcatggtgctcctctggctgggcccacccgcagtggtatccttctgggggcccttaggggagcctgccgggggtgcagatcctgccgggggtgcagagcctgctgggggtgcagatgatttctgggtcccaggaccatgagggggctgctctacacacagcctgaagatgctgcggacccaaactggccctttccctcccacaccaccccaggaccaatgggctggctggaggccacccatgctaaaataggctcaagggcctactttagcttctgggcaaaggtcttggcctgggcctgactactgtggccttcctgagctgcctccccagtaggcctcagtgctgggctacaggcctcctccattccctccattcatgtgaccccacccctcccagcagaaactctcttccgtagcccaggagcagctgttgagggtttcacctgcccatgccccagcctaaggccggcttccccagagcagacgggttgcactctcctgcccctcaggcccactctgtcatccaacaagctcactgcaactggcccatcttaaaaacaacaccggctggtcacgctggctcacacctgtaatcccagcgctgtgggaggccggggcggggggatcacttaaagtcaggagtttaagaccagcctgggcaacatggtgaaacccgagctccactaaaaacacaaaaacaaattaaggcaccctgagtggtggtgggtgcctgtagtcccagcgactcgggaggctgaggcagaattgcttgagcccaggaggtggaggctgcagtgagccacgatcgcatcacgcactccagcccgggcaacctggcaagaccctgactctaaaaagaaaaaaacaccaccaaaaaaaagcccacgttcaatggcagcactattcaaaagatggaagcaactcaagtatccaaacgcgcatgagtgaacacatcgtggttcatccacagtggaacacgattcagccagaaaaaggaaggaaaccggcctgcaccgtgacttggatgcacctggaggagactgtgatgaacgaaagcagccagacgcaaaagggcaaggacggtgtgatctgactgatgtgaggaccccagccagtcaaattcatggagacagaaagtaaaagggttttgggaggccgaggcgggcagatcacctaaggtcaggacttcgagaccagcctagccaacatggtgaaaccccatctctactaaaaaatacaaaaattagccaggcatggtggcggggtcccagctgctcagaagtctgaggcgggagaattgcttgaaccccggaggcagaggttacagtgagctgagatcacgccattgcactctagcctaggcgacagagctagactctgtctcaaaaatagtaataacaaaaaattttaaaataaataaaaaaaatacaggccgggcacagtggctcatacctctaatcccagtactttgggaggccaaggcgggcggatcacctgaggttgggagtataagaccagcctggccaacatggtgaaaacctgtctactaaaaggtacaaaacttagctgggcatagtggcaggagcctgtaatcccagctactcaggaggcgaaggcgggagaactgcttgaacccggaaggcagaggttgcagtgagccgagatcgcaccatagcattccagcctgggcaacagaacgagactctgt

SEQ ID NO: 13455 - DNA, 443 bp, Homo sapiens
ggtggcttatgcctgtaatcccaccactttgggaggctgaggcgggcggatcacgaggtcaggagatcgagaccatcctggctaacacggtgaaaccccgtctctactaaaaataaaaataattagccgggtgtggtggcgggcgcctgtattcccagctactcgggaggctgagagcgtgagaatggcgtgaacccgggaggcgaagcttgcagtgagccgagattgcaccactgcactccagcctggccaacatagcaagactccgtctcaaaaaaaaaaaaaaaatacaaaattagccgggcgtggtggcacatgcctgtaatcccagctactcaggaggctgaggcaggcgactcttgaacctgggaggcggagcttgcattgagccgagattgcaccactgcactccagcctgggcgacagaacgagactccatctca

SEQ ID NO: 13456 - DNA, 380 bp, Homo sapiens
tgtaatgaatcaaagtttaatggatttagggctatgcaggatgtgccttgttaatatgtttgtaggcagtatgcttggtaaaagttatcgccattcttcattctcgattaaccagggacacaatgcactgcgggaagccgcagggacctctgcccaagaaagcctgggaattgtccaaggtttccccccactgagacagcctgagatatggcctcatgggaaaggaaagaccttaccgtcccccagcccaacacctataaagggtctgtgctgaggagtcgtaaagagggaggcctctttgcagttgagataagaggaagccttctgtctcctgctcgtctttgggaatggaatgtctcattgtaaagccaaccattccc

SEQ ID NO: 13457 - DNA, 1454 bp, Homo sapiens
gcagggcgtggtggcttatgcctgtaatcccagcactttgggaggctgaggcgggcggatcacgaggtcaggagatcgagaccatcctggctaacacggtgaaaccccgtctctactaaaaataaaaataattagccgggtgtggtggcgggcgcctgtagtcccagctactcgggaggctgaggcaggagaatggcgtgaacccgggaggcgaagcttgcagtgagccgagattgcaccactgcactccagcctggccaacatagcaagactccgtctcaaaaaaaaaaaaaaaatacaaaattagccgggcgtggtggcacatgcctgtaatcccagctactcaggaggctgaggcaggcgactcttgaacctgggaggcggagcttgcagtgagccgagattgcaccactgcactccagcctgggcgacagaacgagactccatctcaaaaaaaaaaaaaaaaaatacaaaattagccaggcatggtggcacatgcctgtaatcccacctattcaggaggctgaggcaggcgactcttgaacctggcaggtggaggttgcagtgagccgagatcacgccattgcactccagcctggacaacaagagcgaaactccgactcaaacaaacaacaaaatacaaaacttaagccaggctggcggcatacccctgtagtcccagctattcgggaggctgaggcaggagaatcacttgaacctgggaggttgaggctgcagtgagctgagatcatgccactgcactccagcctgggcgacagagccaaactctctctcaaaaaaaaaaaagagaaagaaaagaaagaagggtgactgccagggctgggaaggggagaatgtgtgtgagtgtttaatggggatggagctttactttgtttggatggaaaagttctggaggtagacggtggtgaggttgtacaataatgtaaatacacttaatgcccctgaactgtgtacttaaaatcagttaaaatggcaaaatttgctatattttatcacagtaaaaaaaataaaataggccgggcacggtggttcacgcctgtaatcccagcattttgggaggctgaggcgggcgaatcacctgaggtcaggatttgagactagcgtggctaacatggtggaaccccgtgtttactaaagatacaaaaactagccggctgggcgcggtggctcacgcctgtaatcccagtactttgggaggcggaggccggcagatcacgaggtcaggagatccagaccatcctggctaacatggtgaaaccctgtctctactgaaaatacaaaaaattagctgggcgtggtggcgggtgcctgtagtcccagctacttgggaggctgaggcaggagaatggcatgaacccgggaggcagggcttgcagtgagcagggatggtgccactgcactccagcctgggtggcagagagagactctgtctc

SEQ ID NO: 13458 - DNA, 540 bp, Homo sapiens
gtgggggaaagagagagagatcagattgttactgtgtctatgtagaaaaggaagacataagaaactccattttgatctgtactaagaaaaattgtttttgctttgagatgctgttaacctgtaactttagccccaaccctgtgctcacagaaacatgtgctgtaatgaatcaaagtttaatggatttagggctatgcaggatgtgccttgttaatatgtttgtaggcagtatgcttggtaaaagttatcgccattcttcattctcgattaaccagggacacaatgcactgcgggaagccgcagggacctctgcccaagaaagcctgggaattgtccaaggtttccccccactgagacagcctgagatatggcctcatgggaaaggaaagaccttaccgtcccccagcccaacacctataaagggtctgtgctgaggagtcgtaaagagggaggcctctttgcagttgagataagaggaagccttctgtctcctgctcgtctttgggaatggaatgtctcattgtaaagccaaccattccc

SEQ ID NO: 13459 - DNA, 12991 bp, Homo sapiens
tggccatcttttcttttttttttttttttttttttttgagacggagtctcgctctgtcgcccaggctggagtgcagtggcgcaatctcggctcactgcaagctccgcctccagggttcacgccattctcctgcctcagcctcccgagtagctgggactacaggcgcctgccaccatgccctgctaattttttttttgtatttttagtagagacagggtttcaccgtgttagccaggacggtctcgatctcctcacctcgtgatctgcctgccttggcctcccaaagtgctgggattacaggcgtgcagccgtgcccggctctttcctcctgcttttttcctacactctctcctccctcctctcctccctctttctcctgtttgatttccacctcttttctctcctctctcctctgaatctgcctcttcctcttctcacctccctcttccttccctgtctctcccccttgggtctctcttccttccctctctctggtttctctgtctctgccctgtcctttcctttccctcctctctggacctgtctcctctcctggctctctctccttcaagctctcactcccactggcctccctcccgggagccccgtctcctccgtctccaggtggcccctgcatccctgcctggtgggcctttgcctccctctcctgttcctgccttgcctgctcccaggtttccaggtcctgaccaggaggcaggagtccataccgaggcccaaacaggctagcctgagcaggcccccaagcctgaggcccaggagtggacagacctttgtgacacccattctctcttccttttccatctgtccggaactctggacactgcctggaggaatcaggcctgcgtaggcccaggaaggcggaaacaaagacgacgctcagagacaggaagcaacttgcctaaagatacacagcacgtaaggagcagggacaggactgggtggggcccctggggttggccaggagtgggctcctgaatctgccgatccctggcctcctatctgagctcagtgagcagcggatgacgcctttctgctccattccgctcccttcccaactcttcctctgacaacatgaagcacctcagcactgaggggacctcacctgaattccatttcagaaatgagaaaattggtgcccaatgtttctgaagaccagcaactgctaagacagagacttcgagggaacccgaccttgcctgaaggaccaacagcgccccctgcaggacacttccctccattgagagaagccacaggcgccggcctgaggcattctgagtgcgtggaatcctctattaccacctcctggcaaagaacggagctgcaacccagctatatgagacaccgagaatgatctcaacaaaaaggaacagtgaccagaatgcctgggggaggaacaggggatactgggtggaaggaggggagagggagaagttgtaatattttgtaaaaatgaacatttttactcctaatcaatatacaaacatcatgctcagcaaacttcttggtatgaaacttctgaacttcacacattttcaagtcattctatgggtgggtggattggctcccatggaaatgcaactgggactgcacatgggaaacaaaggaaaatggaatttggttcacacaaacctgtttgggagattgcatttccaggaaatgggccaaattgagtttgtttcctttgtaacaacattgttgtgccttgctgactggaaggtgggtacaaataaaggaggatggactgacagctgaagaggcaccagtaattagcccctaatccttaccagggagtctctctgatgggttaaagaagcctacagaggccaggggcggtggctcacacatgtaatcccagcactttaggagactaaggtggatcgcttgaggtcaggagttcaagaccagcctggccaacatggtgaaacccggtctctactaaaaatacaaaaattggctgggtgtggtggcacacggttgtaatcccagctactcaggaggctgaggcaagagaattgcttgaacctgggaggtggaggttgcattgagccaaaattgagccactgcactccagcctgggtgacaagtgaaactccatcccacaaacacacctgccccccacccaccaaaaaaaaaggagcctatagtttccagtagacaatttggggttagtaaagaattttacaaaatactaaatgtagtcttgtatattttaggattgtttgccatgcaactatgtactgggagcacctaaatgcccacatgaaaccctaggctgggaagaggaaggctttcgcaatgccacgcagccgataacattttctggtggcaggaaatgggagggagcaacccctcctggagcatttaccttgccaggtgctctcacatcttagaccagaagtcacgaggctaggatgagggtccaggaggcagagaatgaggattgagttagggtcaggacagtggacacagagaggaggagacacaggatgggttgggactctatcctgggggaggtgagaggccacgcggagggctgtgagcaggggagtagtgaggtcagctctagtgtcaggaagctctccattagggggatggactgagggggggatgttgggggctgggaggccaaagaggaggctgggccgatggtccaggtggcagaggacgaggcttgagctgggaccaaggccatggagacagaggtgacgggatgaggccaggaagaactttaggggtaggtatggtggtgcataggagaacgtgattgggacagggcagtgctctggtccatgaggttgggcaggtgatggcaccactcactggaacaaagatccctggaggagcacccgatccgggcaggtgggaggcactggctcctttagtggcccctgaggcacatcctggggaaggagcccaggaggcagctggggccatgagtctggagatcaggggtgggatctgagctggagatgagttggggaatcgctggtgaagaggggctgtctggaacctccagggtgaagggatggggcagacacctggagtagcaagggggaagcatgcaccaccatcacacacacatccctctcccccagcaaggtggggcccccgggccatgtcttccacagacacatatgtgtgcaaaatgatgcagcagaacagggggactcctgcagtgctgcttagaactactcaaatccagcaacacactcttacaccagagatggaataagatggcaccttataccagagatggaaactgccccagctatgtcaaaagaaggtgggggaaaagagcaacacttgcaaaactgttgacatgtgcatctgcttgtttctgtggagagtatctgcagcataccaggggacagaaaactcaggctgcctccagggaggggaagtgggtgctggagcccagagtgagcatacagtttctggacgtggattccactgcatcttttgtctattctggagacagggtctcactctgtcacccaggctggagtaaagtgattcaatcacagctcaggaagcatcgaactctggggctcaagcaatcctcctgtctcagcctcccaaacagctgggactacaagcatgaatcactatgcctggccaacctactctatcttttgagtttcatacttcatccctggataacccggtcaataaaataaaatagtgagtgggttccccaaggaccggccagaccgggaagaaaagtttaataagaacagaacgctaggggagcctgaaggagctcaggcatttcctggaataccccacagagtaaccctgccagcctgaaagcaaccgagacttagagggaaaggacataatcaggtttataaagatcccaatgttcaacccaggaaaaataagatgttcccccagtgccggggtagaagacatctgcagatcagacacagggaccaggactccaagttgggaacacttcccaaaaagcatcagtaggcctggcgcagtggctcatgcctgtaatcccagcactttgggaagctgaggcaggtagatcacctgaggtcaggagttcaagactagcctggccaacatggtgaaaccctgtctctactaacaatacaaaaattagccaggtgtgttggcgggcgcctgcaatccccgctatttgggaggctgatgcaggagaatcgcttaaactcaggaagcggaggttgcagtgagctgagatcgtgccattgtactccagcctggatgacagagcgagactctgcctcaaaaaaaaaaaaaaaaaaaaaaaaaaaagcattagtaaatatttcgggaatcctctaggaaaagaatgaagcaggattcacatggaatgaagacagaaaaagcataagctatctcctgcaggtggagaaagaaacagaagttagcaatgctaagactatcttctttattaaagttaccaaaaataggccaggcgcggtggctcacgcctgtaatcccagcactttgggaagccgaggcaggtggatcactcgagtccagcagttcacgaccagcctgggcaatatggtgaaaccccgtctctacaaaaaatacaaaaactagctgcgcgtggtggtgcacgcctacaattccagctactcaggaggctgaggtgggagaatcgctgagcctgagaggtggaggtcgcagtgagtcaaggtaccgccactgcactccagcttgggtaacagagcaagaccctgactcaaaaacaaaaagaagtgatgggagggaaggcaacctcccacggtgcaccacctcctggtcttgacagtcgactcacaaaccatcacttgtttataaacgcgtttccgatctgccatcgtaattccattttagtcatgcatcccgagatcattcaaaccacacccaagagagactggacgacagcactcgctagggtgctatttataaccatacaatgcaggaggctagctgcgtgtcgatctggggggacagtttaataaactgccacacaacacagctgagctccacacagccacatgaggatggggacagccattccttgggtttctgaataacgtatcaagtgagcagtgaatttcaatcaagcttgtacatcaggaccgtcttgccaaaacaacagttgcttttggctgctggaagctgtagcttttcaaaacgttcacacatttcaatgtatcgtcgatgtttttaaatagacttacagggagggtggcacacagcaaaggcccgcaggccctcgtagcaccgcagtccaggtaggatgctgggcggcggggggtggtggagggggttctatttacagtgtctgggctttgactccactaactgttggttttgttttctttcttaaaccttttccttcaagtctggaagcctgtggagggcctgtcaccttaaaggcaaggattccttgtttgcaccaggcagacaaatgtcaaaccacgaccccaggggctgcactaggcgtcgggcccagaagcccctgccatccagccccgactctttcatgcctctgcccctgatgaggggacccagggtaccctcaaggggacacagaagggaggctgcatcctagtccagtgtcaaagtgaggggggcgctgcaggagcctggacaggaccacctagcccagccagggacaggagggtgagaccacctggaacaaaggcacagaggctggagagaaggcggcatgttcccagactgcatgggctcggggtagggggatgcgaggtcagaactggcatagtggccaggatctcgggctctactccatgggcaggggggaacgcctggggctgcatggggccatgggggaggcgggcgcaggagacaccggctgctgtcgcaaaggccccagtccagctgctcctctgccagcagaaggcagaggacaatggggctgcccaggtggcctcgtgggacggggggaaaggagggacagcaaacccttcttgggatggctgaggacacaggggactccagcagaaaggaggccctggtgtgcaagacgggacgctgaccagcctgggccctcaccggcagtgacgcgaacaccacccccacccccacccccaccctggcccccggtgtctggcgctcctgacatcatgaggaacaggacgacgggaatgatgtacatccactgcagccggacggaaggatggacagacagacacagaaagagagagagaggggaaggaggtgagtgtgggcatcacccacccacggtggggaccggcatgaggggaggtcgcgtaaggggagggcgcccaggtcccctacgtcactacaggtcagggagggccagtggggcgcagggaggggcaggggtctcggtcctcactcaggcctcctgtggcggtggcgcgggccctggcgcagcaggacgcagggctgtgagcaacacggccccccccaggatgatgtgccactgaggagggagggagcgcaggtcagggccagtgggctgccgtggcgctgagggccagcagggagtgggagggcgctcgagtgggcagcaggccaggcgccagcaggcaaggctcacctctgggcctcagttccctgcagcacaactgttggactatccaggcggagcgggtgagccctcaggcagggcactcagcacagcaggctcagccatcccagcctcagcatcctcctagcctgctcgggccacacagacctcctcgctgccttggcctgcctgggctcctgtgccacaacctaacaccagctccacactcaatggaccagaggcctgcgtggaagccaccatccgtcctgtcaccagcctccccaccccacgcctcagcctctaagcccccgggactcagacctgtgctggcagcacaggcccctccctcctcagctccaggaggcctcccagcaccctgctgcccccaatgcccctccctgggccacatccctcccggacccactcctctctccttcctgtacaaccccctggagaacctgctcgcccctcctttccaagcctccctggttcctttgaaacctccactgttcccttcctctccagcctcatggctccaacctagctcaggccgagacctcccccaggaccctgcgccctagagctggcccgacctcccctgaccacacttccataccctcttcctgcaaacaagcctcagcccaggtaccaggacacacaggaggcccggaggacaaggagcaggcccgagcaccataggggagtctgggtgggagcatggagggcctggccaggcaccgggcactgtcaggaagggaataggggaggcgggggagcccactcacgtatttggcgaagaaggacttctgctcctgggggttcttggccttctgggcatgttccatctccaggcgctcaatgaaggccgccgtctcagggctggggcaaggggagaggaggagaagggtgaggcccggagtccagggacctggagaccctgaggccgccaggaagggccggggcaggtggcaagagcgccgcgaaggcagcagaggctcaccctggggctgtggtgggcggctgcagctgcaccgaggtgttgaacagctccaggtccacgtcctccacctcatggccccggcagcccccggggtgcgtcaccaccgacacgcccaccacgttgccggccacatccacgtgcagggtcagctggtccgacaggtgcgactccaccagggagcactgtagggggagtggggtcagtggaggtggggagcctgctgcctgggctccaccctaacctcccccggcccccaccacaggacccccggagcatttttcaaaaccttcccatggctccctgttaccctcaggcccaagttcaaccgccccccacccgggagtcctcacaatgctatccccatgaaagcacccgctacctggaccgacccctccagaccaggaggcctcggagagcaaggccaggtctgagtctcccaggcctctgcgggctccagaaacacaggggttcgaatggtggaagcaggaccagggtaggggatgaggaggacgagggagaagggggctcatccccgacaccaactcaccgcagggacaaaggaggagacatagccaccagcttccagccatccagggccccgggtcgccttgggatccggacccggtacaggccattcagggctgccacatcctggggatgggagaagagggtgctggtcagaaggatggtgtcagccctggacaggctgtgatgcccaccaggactccgcgaaggcccctctccagccccacccacctcacggcccacactccccaggccagccaacctgagtcgacccaggactcttcctgttggggtggcccggctggtgggtgaggccaggagcagctgggaccgccccacctaggggaaaagccaccacaaggagggcaaagcccagcccagcgatggagtgggtcctgaggacgccttccctgtgcctggatccagctgcacctggcgtccaccctatgcctggacgtaccagttacatgcataataaattctgtttggggacagctgtgacaagagaatcatgtgggtaccatgcaggaagggtgctcaggcagacctcaccgcgtggccaccagaatcaagcctgcactccccagcctccctcacagctacatctggctgatgggtggaagtgggttgtgccagcttttgcaagctttctctaaatgctgctgctccttctgcccctctttctccctctctatcctgctgcctggagccctggggcctctctgcatgacccctgcggaggattgagctgggcccttgaggctgccacaacacagggcgacagaagtgagctcctgtccaaccatagctattttgaggctttctcctcacaaacaaatctcatctaagtggtcatgaaacagctcagctgatctggaaaagaagaggagccgactgtgtgaacctgcaggggaagggggtctgccagcagagggagcagtgcaggaagaggccgtgatgcaggacaccatgcctggcggcgctaagacgaactgcaatgccgttcctccaggggcagtcattgaggacagaggctgagagtggcaggtggtgctgggagcccacctgggcctggagggaaggctgctggggaccagcagggggtggctgaagagacagctggaaaccctccatccccatccacacccagccctgagggccccacctcacccggagtcggccccgctcctcctcgctgagctgccgctgtgacagggacaaggtaccatcctgctggttccagagcagtgagccccgcttccggaagttggcactgtcatctgtgaggagctcaggttcagagacgccccctcccccgcccacccttcaacccaggcaggggccaggaggtccagcttcaaattttggcctggcctccacccgagtgaccaggttccctccccatcttggcccccattttgctatctgcaaagtggggacacctccaccatgttccacctcacaaggcaacccgtagcagatgcatgaaccccacagctcccaaatcctgcctctgcctcgccaggtgacccagggatagccacacaacctctctgagcctcagcttccccaactgcaaaatacggaggctgtggagttcaggaattcccaactacctggccatgtcagaatcaggggagctgttcactgagcagatgccagggtttgcagaggggcaccagcttcagggtttgtgcctcaggttcggggcctcagactcgattactacactctgggcagcactgacgtccagctctgggaacctggacacctgcatcatggcaatttaagtttgggtttgaagctggcccctgctctgccactcactcacgatgagaccttgtgtggtgcctactctgagcccgtttcctcttctggaaaaaggggctgacacgaatacctaccacctcacatggctgctgtgaggacatctgagttaatacttgcaaagcgtggaaccgctaatgctgggcacgtggcgactgatcaggaaagccgctctgaaattattactgctgtgatgaccttttaaaaactgaggtttgtctcacaggcaagggggcatttaaagagtgtttctcttctttcatgtcccactttcccctaacctgaggcaaatctgttagtaaatggttgttagtaaatgtcatacgacgggaggcacccagactccaagtcttgacttctcagggcaccaatgttaagtgtctaggagaggacgttgcctgactcaccgatctcaaatgagtgctccagcagcagccccaccgtgccacaggcctcgccctctcgaccttccgccccagcctgcagaggacacagaaggccccaggtgaggaccacccaagccctcagcatagtagtcacccacagaacccaggacagacagactggtgggctgagggaggagccttatcttcaagttaatcactgctgcttgcctttatttcactagaaaccacccatttcatgaatattcatactctgcactccctcacccccagaaaaccagaccctacaaacatgcctaacctcattgccaaagcaactatcccaaggtcacttccaagccttgcgccacaaatactcatgagttaaatgacactctccctctcccaagccttctttttcatgctaatattcaaatggcctccttatcacctgacagcccaatagccaagatgcagcctgagttcagtccctattaagcacattcaagattcatgctttccttttctccaacctccaaacttgcatactcacgcatatttaggagacaaaactcatctccacttcctcaagagccccctcccacgccttattttctttttctgagacagggtctcgctcagtcgcccaggctggagtgcagtagcgtgatctcagctccctgcaacctctgcctcctgggttcaagcgattctcctgcctcagcctcccgagtagttggaattacaggcacctgccaccacatccagctaatttttgtgtttttagtagagacggggtttcaccattttgagcaggctggtcttgaactcctgacttcaagtagtccgcccgcctcggcttcccgaagtgctgggattacaagcatgagccaccgcgaccggcctaatttttttttttttttttttttttttttttagtattttttgtagagacagggctcgctatgttgcccaggctggtcttgaactcctggcctagagcaatcctcccgcctcggcctccctaagcgttgggatgacagatgagccaccgcgcccggcttcaccttgcctctttcatttcaaccgcccggacgtcggattctccaagattccacacccccagccccgccccctcatacatattcccgagccagagccttccgacaggtgcgcttgtcctcccacccagtccttgcaacccggtgcactggcgaggcccctcctgcgcgtgcgtgactgaggcctggctttccagggatctcccacctcttccctctcagccctgcgcagcctccttccgtctgtaactcacctaaagacccaagacctgcgacatccgtagaccgcgcccgctatgcacagctaaagagcactcacccctcgcgcaccagtcccggcccggcagccgctgccccgggctcgactgggcgctgctaccgccatcagcaagagcaggagcagccgggttgccccagcgctggctgccgccatctcggcttcttcccaccagcgaagggacggctgtgagccaagagccgcggagcacgccgggaggaacaggccgcatcctgacgcccgtggcctgcgctgggccccggcacctgcgcactggcacccgtccgcacctggggcctgacgtcagcaggatggggccgcccctttggcctgatctccaggagccgccccctccagggacgtcatcacaaatcaggagcccgctcttgtgtgacgtcataaagcccgctccgcatcatgacgtcacagtgcgcgtagtcccgccccctcgctttctccctctgctcctccgtccgctcccgtcggacggggacattgcaatgaggcgggatcgcggccctaagccggccctgggtggagctggcgaggtggaaccaggtgggatggcaggtgagagaggggagccaggcctagaggggttggacctggtgaaggaaccaagtaggatggggccggcaattcgggggcatctgataccccgtcctctccgcggggctgtgcgggccctctcagttgggaagccaggcacagcctcccaggatcgacccccagacttcgtcctggtaaaatgcctcctggttgcagcctctcccacgggccgtcccagacggctccaacgctacctccagagcggcgaattcgaccagtttcgggacttccccatctttgagagcaattcgtacaggtagggagccccagaaccccctcatccccagcctcggcctgcccctcgacctcctcctgacttggaaagcccctgctcccccataacgtccatctcgtgggattcccgactcccaactcctatgtgatctctgacaccccatacttctagttctctagattctttgtgaaccctggcctgtaactcccttgcctcggtttccctgacttcacacccatatgattcttgaactttaatttcaagatatctggcccccagcctgattttcaactcacctggttcatgaccttttcccctaccgagattcctaacctctgatccctcctcagttctgccccgacatctatcctgccccgacctctgacctctggccccaggtgactcggttgggagaagttgccaacgaggtcaccatgggggtggcagcctccagtccagccctggagctcccggacctattgcttctggccggccctgccaaggagaacggacacctgcaactcttcggg

SEQ ID NO: 13460 - DNA, 298 bp, Homo sapiens
ggccgggtgcggtggctcacgcttgtaatcccagcactttgggaggctgaggtgggtggatcacgaggtcaagagaacgagaccatcctggctaacacagtgaaaccccgtctctactaaaaatacaaaaaattagtcgggcgtggtggtgagcgcctgtagtcccagctactcgggaggctgaggcaggagaatggcgtgaacccaggaggcggaggttgcagtgagctgagattgcgccactgcactccagcctgggcgacagagcgagactccatctcaaaaaaaaaaaaaaaaa

SEQ ID NO: 13461 - DNA, 16523 bp, Homo sapiens
gattgctgacctgcagctgcataaactggatgaactggactgtctgattcagggcctgctttatgtcgactctgttggcttcaacggcaagccagaatgttactattttgaaaatcccacaaatcctgaattgtgtcaaaaaaagccgtactgccttgataacccataccctatgttgctggttaacatgggctcaggtgtcagcattctagccgtgtactccaaggacaactataaaagagttacagggaccaggtaaacatgtttctgcttgtgcttgaacccagacctctttcttgatgaccagtttatagtaaaaggttatttatattgaatacatttttaaaagaaatatcttggcctccttggccaaccaaaaagaatttatcaaatggtgtgttaaagtggtatgtgggtgatttatataaatgttaataaaacagttcttgccttgatagaaactttggtcaggttgagggaagaaggatcgcacacaccagaaatttgccaagaaggaggcatacattaagtgccaaatgattggcagggtcagtagaattcagatggaaggatacttgggatggtcacagatgacttcagaaggaaccttcttttggaccctcattgatgcctagctcggagtgacttgcttgaaataatataccattccaaacagcaaaccaaactatgtctacaaagaatgtttttttaccctcagccaaatgctccacctgaaaactggaatagtcagcatacctcctagggaattttggagtggagtagacagggaaacagccccatggccatggtggggcagagggccttgtttttcagtgcacacaccccaaggcccatgtaagagccaaggggctcagcttcctgttaacgggtattcaacatgggaaaaacatctagggtcagatctctctaagacatcacagtgtaaacaaaactaaataggttttccttaattctaggaggaggatttgatatgaagcatttctccagcatgtggaaccatagaacccatttttagaggaacaacttaggagattagtgccatgtagaatgtgctttgggacttgatgttgaaaccagtgtttttgatagatgcagatatcgtgtcacttctctgggtctcagtatcctcatttctgccatgaagggtgctgtttcttagatcgcttctacagactttttccagtactgaaattctgcaggactactcacccattaggaggagaacattgcttttgcagtacatttccatgacttgtgataaatgagtggttccccactgaagaggggaagatttaacagtgtcccccaggacatgtttgacatctttttttctttggttgttacaactggcatctagtgggtagaggtcaggggtgctgccaaaatcctatagtacataaggtaacaaaaaattattgagcctcaaatatcactaatgctgctgttgagaaaccctggcatgcatgtacacacacaaacacacacacacattctaattgaaacctacttgtgtccagagtataggctttgttttgtaagttaattgctaccaagtatacattttctcattgagaatatagaagtttgcttgctcacacaagaaacaaaactgactccgtgacctcatgaggactgtcaggaatatcagagacatgaatatttcagctgagttggttttacattagagagtgatttgataaacataatttttaaacaactacagaccgcctcccagaaggagtaattgaattggtaaagctagtcccaaggtaacagcaagctatacattgttcaccattagagatatctagttttattaacacttaacaatttaatgaattacatcacaggtacactttcttaaacttggaggctccgcagatctgggtcatcttggatagctgcaaagaagcaaactgtggtgtttggcttctattatgtgtgtaataatgtctataaatattggtaaatgcccattaatgtccagtattctccagtcatcaacaaattctgtctggatgttcaagcttccctataaactctctcttcaatcagtagttttggaaaggtgctaccgaagcctgcaggttaatagagaaccctttcaggggctaccacgagaagggaggggaatgaaacatcaagtctgtggggctgtgatcctgatccagagttgttttgccaaaggtttcttttaattcaagttaggaaacctctgacataaacgattacagttagcagtgaagttagtatctatggttagtatgagtgtgtaaaacacattttgggaaccactgttttagcaaatggcttagctttaagttttgctactcctattgtgaactgatagctgtcactccaggttttttcttattgtattatacctgattttcccattaaacattaaagatgtttatttttaagaagctacacaggatgtcagtttccttttaaacatgatttcaaatggtttatttcagtgttatatataattttgttgcatcccagattgggtagcaacatttttttcctagtgacacaactcgaattatagaagtcaatggaagaaatagtacttcatagctgacagtagaatgtgtaatctgttaaaagaggaatgcagataattttgaaactttggtgaaagtagcagtacatctcatctcattattttggaatctgttttaagggcatgagcacttaattgaaggtttcttctgctgtttcctaacatcccccactatgatgttgtttgttttatttttaaatgatgataatattctacagctttttcttgcattgtttttctctctgatatactgagagtttttactgtatgcctactgaaacaaacagatgcatctgattgtgagcaagaaaatcacttgattaaataatggttagcaggttaaggatattaataaagtgctgggagacatttggctcttctgcagccatgcattctttcctcctatctgcagtgcactcactgtgcaaatgcatgctcgctttacctcatttgctccaattctttatgtggagttgtctgtcattttccagtcatacaaggcacttgccctttttcatttataccaacacatcagccaatgggttaccttctttctaagttagccagtgtcttcagttgcctacctttggagtgggttgttgaatgcctcgattgatacaaatccttaatgtccaaagaaagattattcatggggatgacagatatttagaagctagaaatggaagcaaagacatctttctaaaaacacacagggagaaaacaaaacaaatccaaatagcacacaaaccaaaacatgttcccaccgtagttttgtaggtaggctgaaaccagcaatgtagaatgacatactgcattaaatgtgaataaagataaactttcttagaggaaatccaaagtttgtactgtgactaagttgtgaaggtaataatgtacatggacctcttcctttactcatggaactgcatctacagtttgggtatctgctactggtggtacctagctacataattttccatgaaaacccataatttcaatcatatatatatgtgtgtgtgtacatatatatattagtaaatgaagttatatatatatatatatatatatatatatatatatatatattttttttttttttttttaagatggagtccggctctgtcacccaggctggagtgcagtggtgcaatctcggctcactacagcctccaccagggtacaagtaatccccgcacctcagcatccagagtagctaggattacaggcgcgtgccaccaaggctggctaatttttgtatttttaatagagacagggtttcaccgtgttgaccaggctggtctcaaactcctgacctcaggtgatccacccaccttggcctgcaaaagtgctgggattacaggcataagccaccacgcctggcctcaatcaagtatacttttatacaaatgacaatttaagaatattacacatagtttcactatttcattttattttattattttttgagatggagtctcgctgtgtctgtcgcccaggctggagtgcaatggcacaatcccggctcactgcaacctccacctcctgggttcaagcaattctccttcctcagttttctgagtagcttggattacaggtgtcagccaccacacctggctaatttttgtatttttaatggagacagagtttcaccttgttggccaggctggtctcaaactcctgacctcaagtaatttgcctgtctcagcctcccaaagtgctggtattacaggcatgagccaccacgcccggtcagtttcgttttagatgcatcttcaagaactatgtacctatctacagttttgtaccttcttgttaacagttattgacattattaaacataaccttaatcccaaattgattttattcttagaagtaaaagccagtgctcaaacacaaattgaatttccaaagctagtagctctttggggcttcagaacagatggatgtgagcagctcttcttcatttactcttctacatggtaaagaaataggaaaacctatgtccattagctttaggaatcaatactccttttcctgctgggagttcactggcgatactttactctgaatctgcttttctttccattaggtaactttgatattaatacacaattgagttcattcttggctactgtaattactttctaattttgtctaggctgttttagaggaactttccctctaaacaagtcaaagctttttaaatgtagttcaaccattggaaccactttatgacctttgttactgttttttactatggagtggtaagtaatatactaaaaaccttctggagagtctactaggaaaaaattcagtatcagatcagtggttcctttctagaaatattcaaggaggctaaatgagattatctctgctagagaagcaaggtcaggtaaaacacagcttttaagacaggccactcctggcacaatcctgggtcagttttgtcatcagagggtttggcttcatagctttgaactatgctttatgtacacacaaattctttttctaggtatttatattcagctgcatatggttttttaataggagttatttcttggttatttgctgctttcagaccacccaaatagaagagatcatgatttggccccatttcataggtgggaaggctgaacaaagcactcaggttagtggctagttgaaggtctcacaacagaaatcagtgagagtctttctttggttttgttctcaaatttaggggcaaattttccttgatgtttatttttagtctctgccctcttttcatatccagtctaccctaaagctctgttgcaccctagcactttaattcaagtgcccctttgttcgtctgcttttattcacccatattaatagtcttgacgtagttggggacttggatgggcatatcttaaagtaaaatttaaaaataaaccttattattccttcagtcttggaggtggaacattcctaggcctatgttgcttgctgactggttgtgagacctttgaagaagctctggaaatggcagctaaaggcgacagcaccaatgttgataaactggtgaaggacatttacggaggagactatgaacgatttggccttcaaggatctgctgtagcatcaaggtagagattaagtagctaggagcagtagtgattaaacacaaggcagcctctccaccctggccattcactaagttgttttaaaatgtcagtccaccagcctggtgcagatacctgttgtatcagagctcagacttgatctcctgcccttgatgaagcactgagatgtttagctcttgatgcttgttcttaaaataaggcaactttgaaagaaggttctagaaaactgcaatagtttcacctgttccattcttgtccagatatctagaggcattaattttccccccccattaatggacatgctactttgtccctattaagaaaagggcggtcagccatgcatactataattctgtctgcttataaaccatagtagcaaaattggatcacttgagtttgaacagttactcgtagagccttccacaatactttggtggaaggatgggccctgcctgaggacgattttgaacactctcgctgatatttccaacatagctttggcaacatgatgagtaaagaaaagcgagattccatcagcaaggaagacctcgcccgggccacattggtcaccatcaccaacaacattggctccattgctcggatgtgcgcgttgaatgaggtaaggccttactcaacccggtgaaagctgtgtgtcattcatatacatcatcttggcagtgcaacacctgttgactcttacacaactacatatccttaggaaagcttccctttactctagtcacactttacagaacaggaggggtgtgtgttgggggagggggaggaatatatgctttatttttaagaaggcactggatgataatgaatgataaaccattcacctgtggaaacaggatacaattacaacccatgtcatagtctctctaaccatcattattgccatgtgtccactgaaatgtgaggaaaaggtctgagcatccttgcacataactgcaggtaaaatgctcgacttgcaatattcgatattctctctgctttcagcttctttacagtgttgccttgtggcatggagttcaagcagcattgtacagggctatcaaagcacagagagcttgctacagccaaggccagccagagtcccaggcacaaaaaggggtggagctggtgacatacaaagttgtattaacatgttttgaagcattgcaagattcgtttggaaaaaattgaaccttttctgaaatacaaggtgtataaagtagaactcttcacactgaggtatattagaaagacaggaaagaggagttgaggcatggaacaggtcataggagagtattaaagaaccacagtagatctgtaatggagtttttataaatacagcttttaatagaggtgacatacatacagaagaaggctcaaattataagcttacagtttaatttacacacacaagcaaccctgtatagccatcacccagatcaagaaatagaacattataggtactcagaaagccccttgagccccctctcagttgaatagttgaatgttagtgtatgaggcagtctttatgatacatgggtgttagccctgcctttgagttctgggttgacaaaaaacatactctccttgcataacactgaacagagtatgttactggcctgcagatcagcgatatacctttttggaagccctcagttcagacggagtttaaatgggaggctgatactcagagaaaagagcattccagagatgttttttcaaagtccacttgagtcatgggactcaatgtaacagagtttatttcttgacattaacctttaaagggaatttttccaagtaatgaaacaagccccaagaccaatatgtgtgtagttggctgtactcatgggctctcaaaggtcagctggtaacaacccttgccccacagagcaatagatgccctttcccctactttccgcagagctggcttcttgtgctttttgctggagtgagccagcaggtcagcaggtcttttcacaggcatcagaatccctttgggagagagcaactgactttacttttcacttttgatttcaatttcaatattgttgattggtggagtagagcgagtgccaatttgaaaatgtagccatgttatacactggtttgagcaactattttatatgtttctgtggggctgaatgagtgaagggaatcaccagtcgccttggggccaaggctctaccagagggtgtccagtcagtgcagactcccagtggccgcaccagtgactggcagtgttgcatttcccatgagagcagccaccaagtccctcagtccttgctttgctctctggagtcactgatttgagaacctttgattgcagccatttcattgagggacaccacgtttaccaaatctaaaacatttttgctgtgattcttgagatgctgtgaaatgcttccccatcagttataaattttctgattcaaatttttggatagataatacaaacacataatacagacttctaagacattagaaggatacacaaggaagtgagtcaccatttccacttctgtctctcagtgttaacctcagtagaggctgccattttttttagggtttttttgtttgtttttattgtacgtattacaatatatctttgtttatattgtatgtaatgtaggatacatttatctttccaaaggtagcaaactctatatagcattctttttacaaaataatagctttattgaaatataattatatgctatacaattcaccctccatatactattctatatcttgctttatcagctttttattaagaaaattcataaacatatgtaaaggagagagaacagtataaagaacctccattaatccatcagtgcagattctgcaatcattaaggcttcacaacacatgctttctctatattttcttcttcctcctccctctggtcctctctccttcttccctcttttttgctaaaatactagaaaacaaatcccagatattatatcaatctaccctatatattttaataagcatctctaaaaatactgccttttgctttttgacgtaataacgcatcttgaaattgatcatatcagtatattttaaattgcttcatttttaatggccatatagcattttaacatatagatatgctgttattgatttgttcaatttcctaatgatatttaggtttttccagtcttttactattatttaaaaattcagtgtatttgtatacggtatacacacatatatgtacacacatgtatattattttgcctacatgtgagtatatcaataggataaattcctagaagggaacttgctgagtcatcggatatgttgattgtaatattaacagatataaagttccctccataaaggtggttctaatttacattcccaccaagcagggttataacggtacaagtttctccacagagttatcaaactttttgatttttttcaatgtaataggttaaaaattataccttattttgggattaactattaatattatttactcattactctattgggttgttggactttttttcttgttgatttatggaactctttattaattaacaaatccattttatgtgaaatgtactgataatattttccatttattgcttcccgtttggatttgtttgtggtgatgtttttccccgaataaatttaactttttaaagtaaatgtagcaattattttgagatgatttcctttattatgcattttctacttcaacttttttttccaattcttccatatttttccctatctctttttcttttctttctttctttttttttttttcttttttaacatctttgacccacctggaatttatttgaaacatggaatgctcttccagttttaatgccacttctactccttctgactttctattagggtaatgcaggactgggctttgagcaaatcctcccttggactcccctgttttgggagaaagggcaaaactcctcaatttaattaaatttctttttagtctgagtttcttagagtgttccttgctacctcttagtttgggtgatttgtggctagttttttgtttttttttttaatgaaaatttattaaaactacctccactcctccacccacggaaaattttcagtggctaatgggttaatgaacattcattgttaaaacttgaggcagttaaaaggtgatgttcccagaccctgattactcttgatagactaagcagaaaataataccagcttcaaagactctcttgcctttgatatgagtgaccatagcaactggctctaagtgagtgagtgagtggtgagcagtctctgcatggtagacaggttgagctccagtttgagcttaagaaatatctcggggagtgggaagtataacgagtgcactggagctagaagcttacgggatttgaagcatgtctgcatgaaccggataggagaggaatgttcataagtgtatgttcagaatgcaaagccacatccatgatgacaaaaatagaattattttttgttaccatattttaactcatgtgttggccaaacaggatattccaccacatatcctgagggcagagactgagtattctttcttctttgtatttctagtgtccagcacagaacaaattgagcattattcattacacaaataaaccataccatagccgttttatttgtgagttggttataagagtattttatacctagaagttgggggattgaggtattacacatgaaaatttagctgaacttgaactccagttaaaattgtatatatacgtatgttttgagagcttaatgtcagacgtaaggcagtctgacataacacctgcaaataagtccaatatcagtttctgccttgcccaacaaaaatctcagcctcttgttcttgtggaatgcactataaggttggtttaacttcattttggcgatgttgaaataattccaccaaaaaaacaaggaatattcactcttcaaggttctgtacagagacatacagaacattgggtctttgccaaatgctatttttatgccatgattcaattgttttctttaatattttttccagaacatagacagagttgtgtttgttggaaattttctcagaatcaatatggtctccatgaagctgctggcatatgccatggatttttggtccaaaggacaactgaaagctctgtttttggaacatgaggtaggttgagcttgcatagacttactgtcatatgtggagtatattttggtttggctaacatatcagcaggtctcttagctttttaaattggtcaagtagaaaagttgccatttacactttgcatttacacaaaggataagaaaaaagcatatataaaatggaagcgttcttatccaacaaccaggactggtagttggttaatttaattttttaaaaagtcactggaaatgtaaattaggacagtcattatagaaaactgcatggaagtttcaaaaaaactaaaaataaaattaccatatgatccagcagttccacctctgaatacttacccaaaagatttaaaatcagtatgtcgaagagatgcctgcactcccatgtttattgcagcactactcacaataactaggttatggaattatcctaagtgtctatcagcagatgaatggattttttttttaatgtggtacatatacacaatggaatactattcagcacttaaaaagaaattctgtaatatgcaacaacatggatggaattggaaaaaatgctaagataagccaggcacagaaagacaaatactacatgtcctcacttatttgtggaatctaaaacaatcaaactcatagaagcagagagtagaatggtggttacagaggctggcgggtagaggaaatgggaacatacatttcaaacttgtaaatttcaaatgttctcaccaaagaaatctaagtatttgaagttatatacatgttaattagcttgctttaattatttcacattgtattcataaatcataacctcactttgtaccccataaatatatacgattataagttgtcaatttataataacatttttaaaaagttttaaagtcagataaaatgagtaatcattaatgaaagctttcttcaaccattttattataccttaaaatgtgtaaatgtgcacttacttaccaatcttttgatgtgagaccaacgcctatttttgagcatggtttctccgattggagtcctgtagttatctttctttcataatctacaatattatgcacctcctttgatttccagtttgtttccttaaagtggattaagaagataaagatacttatgaagtaaattggttgcagaatgtttacaggtttttctctctctctttcacgttgtggcatccacctaagtagacagcaattatttctgactacctttttcaatatttctcaagaatttaactgaattttcatagaactgaccattaatttgtgctctttttattgatttaggtggtatatagttaaactagattattacattacaatcaacctgtcataaacaaatttaaggataaacacagctgactcttggcaagtaagcaattcagctggtaagaacagaagtgcttgggctactaagagtagcttattggccttgagaggtcagtgtacctgaccattagtgaacctctttacaaaggaaatggagagtgtcagtaaattcagagtcccttattggagtttcttttttttttttgagacagagtctccctctgtcacccaggctggagtgcagtggcgcaatcttggctcactgctacctccacctcccaggttcaagcaattctcgagcctcagcctcccaagtagctgggattacagacgtgcgccaccacacctggctaattttcatatttttagtagagggtttcaccatgttggccaggatggtctcgaactcctgacctcaggtaatccacccgcctcagcctcctaaagtgctgggattacaggcgtgagccaccccggcccccttacttggagtttctaccataatataaaccaaaaagtgggggcccttctctcttccacctcctctgtcacctcctttaaaatcaatgctgcagtgctgcaatgagctatcactggaggtatctaatctcttgtatacactgcagcagaaaaacattgagagagctggtattgtcaatttcaattgtaatgaataactactgtgccatttttttctcatttttaagctgagctatttatttaagaagttaccaatgcatttagagttatttagaactctctatgcctgcattttgttttattaaagtatatgaaacaggtacttaaatacaaaatagttaaggcccaatgatagaaattcatactaaagaaagctcttgtttttaaagcagactttaggcattgagtgagggggaatgaggtcccagaacctccactccctaccccccacagccagaatacctgattatttatggagtttccatgtaaggttttgtttgaaaaagaaaaaaacatctcagcctttaaaaaaaataatgaaaaaggaaaaagaaaactcctgttctagtccagatagagttgccatttttagcaataaaaaatacagggtgcccagttattttatctgccatttatctgtgtcttatctggtaaccataagtccagatcttcttggcctaatgcagacaacaaagcctggaaactgtcagggataaaaagtcttctataacatcaggtgggaagttaggtggtaagataggaaataaaagccaacattttggggaaactcacttctgtaggtaaaaatgtagtcgcctatatcaccctgtacaatcctaagcctctgtggactctggctttggtttgttaccctatatcataactcagtctctatggccagtgaaaatggagtattcttgtaaccctcataatgtgttcctcagaaaattctctacattcttaaattccctctggcttacgcgggccttactagagaatattatggagagacaacttttgagaagcacgggtatggtggctttctggtcacctgccctggccttaggagtcctcactaaatttctcattcattcaactaatgttactgaacatctcttaagagaagtcatctagccaggtagttaagaacactgcgttttactgactgtgagatcttagacaatgactctgtctctccatttctgttttagcatttgtaaaatggggcaattatatttgtctcatagagttattgtgatgggtaaatgagtaaatccatgtaaagtgcttagaacaacttctagcattagtggggcctcaataaatgtaagcagacagcagcagcagcagcagcaaagatccatccacatcctgccacactcacacctactgctgcagttataactattgagttcagcaagtgccagaagaatggagcctcctgccttttggaaacagattgctgtggactgattatttgtgccgtgaccaacttcaaatgtctatgttgaaatcctaatctacaaagtgatggtattgggaggtggcctttgggaggtgattaagtcatgagggctgagccttcatgaatgggattagcatccttataaaaaggtctaagggagctcccttgccccttccaccacgtaatccagccatgtgagattacaatgtgaagacagctatctgtgaggaatgggtcctcaccagacaccttgattttagacttcccagcctctagaactgtgagaaacaaatttctattgtttataagccacccagtctagggtactttgttatatatagcagcctgaacaaactaacacatagttctctaaaaatttatattttttagttcctttcattttcatagacgtatggtcttttattttacagatgggcaaagtaaggcttggactaatttaagtgcctttgcaagagctactgagggaagtttagggttttctctcatgaaatatagctttaaagtcagacagatttggtattgagccctggtacaagacctgtgaccctgcaagggtaatttactttattaccttccatttctcatatgtgaaataatagtcagtgttttgccatgacaaagataaagatgaaatagttataatactaacaaccctggcacacacttagcacacatgtaccagacatagttctaagcatttacatatgtgaatgtatttaatatatataagtaggtgtccaataaattatagttgttattattctgccatgttttgtgacacacaatttaggttttaaatttctcttttatcgatattagtggcattcctagaattattaaaaacaatacatatttggctaaggttcagagatcatcgttttgtattgttttcgtagggttattttggagccgttggggcactgttggaactgttcaaaatgactgatgacaagtagagacgagcagtggaggaaacagcctcccaaaaggacagagaactaaaaaattgctgctggagaaggtgaaagtcgctttgggacggaagccaagccattatggcagatgaacctgctggatttgtaaataatttaaaatccttccagatgatcttttactcttaggttttgagctaatgattcaaaacgggggaatataaaaggttttttttctgtatactgtatttttttaaaaaaatggtgcagcgtggccaaacctaccaattgtatgcattaactttgaaaagttgtttgatgtttaagaaggacctgatatgtaagcgctggtcatttttcttctggggtttactgatcagtgtggtgattttaacttcatttagtaattactctaggagattttaccttgacttatatttttcatgacgtttcatgatttgctgttggtttcaaatgaaactacaaatctggcatgttttactgtgaacacttttgttatttgttttgtacccttttttgtcttgtttttctgttttagttgtcttctgaaaaaagagtcgttccctctgtttctgtcctcagatgatgtccctccccctacctgtaacctttctttgacataattgttcatatcaatgaaggtgctgaccagctcaatacaaagttaagcacaagatctaaagctcttgaaaatgcccgtgaagagaagactgaatgtgttaatgaatttaatgagtctggcaaaagttgcaaattatatgcaagtttgtcctatcgcttataaatgtagtgtttcattggatttattttatgctaggttatattaagttgaaatagtctgtgattaaatgtcctcatccatgcacagaatatgaatggcagcaaatctttgtgcaagaaatttgaaacttattgggaaaagcctcccagtagattaattgttcatatcaggagatttagggtaagtcatgggttgaggtgtcagatagtaatatctatttgttttgtacatgtatatatctaggaactttgtaacaacacatctttaataatgttaaaggttttttcatttttaatattttaaactaaaaactgtacttcaatctcagtttctaaaattaaaaataatttatactgatctatatattttttctttttgaaagatttcattaagactgatgggtaactttcaaatgagggtcatgtacaaatattgggatgcatgagatcccatgatcttgtgtattgagcttattgttgaaagggatttttgaaggacagaacaattactccatgatgaatcttcctttctctgccttctgagcaccgtctttaatttccatatcttcaagtcttgaagaagttgatgttaattgaagaattcacttgtctggttgaaataaagcctgtttctgttgtgatgtt

SEQ ID NO: 13462 - DNA, 1744 bp, Homo sapiens
gaatattaagaagttactctgtgccaggaaggaactggagactaagatgcataggatacagcccctgcagagaaagacagcaaaatctcaagccaacatcagtcatcaagtgccacaagtgccattcaatcatttattcattcacattcacagcagtaaacagaacaaagatccaccatcacagagcttatattctagaagggaagacaggtacattactaaatatataatgttagatcagtactacaaagaaaaagtaagctggtgtaaaggctaaataaggggtagttctattcagaaaaatgagaaggggaggaatatctcagggtggtctaagacagcctttcctaggaagtgacctttgagcagagagttgaatggaggtgagaacacattgtgtaaatgtctgagaaaatatttttcactcctggcaaatgaaaatagggatttgaggaactgcaaagaggccagtgtctggagttaaaaatagaaagtggtgggagatgcagtgttgggagtaaacttgagccaggtcctataagaaatctgtgagggtagtggcctctacccagaagagaggttggtcatttgtcttccagaaggtgctagagaaggttttgtgaagtcttaaccaaagaataggaatcactaagtggagaggaagggagggctttccaagcagagggagctgggtgagcagaagcgctgagggaagaaaccacttggcttattcagggactggaagctctttgctatagctggagcctggttcatgagacagaaaccaggtagtgagaaagaggaagctggcccaactgtggaaggacttgtcttccatgctaacattgcggacttttccgtagtcactgtggagccatcaaagagtttcaaggaaagtgaaactagaaataatcaggtttcaaagtggtaaagcaaaatgctctgttgaagtaaatgagtaaacaagttacgtacttttgaatacctaacattattccatttttttccctattgtgccagacctcatgcagtagctacagagtgaaccatgctttcgctgtaagtaggatggctataaaaattattgagaactttctcagaggacacaggctactaatagctacagccccactatgagtctattcattgagcaagaaggtttcaatactgggagcatcgtaaactatcactcacaagaattgttagaaagcagttttcctcccagtgatcagaagatgacgccacatttgtgaaaaagatttcattagtgtacatcgtttattaggtctaccagctgcccattcttttgctcatctgtttaatttttaataaatatcaatgatctgagaggcattgggtagcactgaggatgcaatccgatgtgaacaagacttcaggagctctgctttcattaggcttacatttggttaatggagataaacttgaagcatataaaccaataaataaacaagaaaatatcagggagtgacaattgctattaaggaaagaaacagggtgataggatagagagggaggagagagacttcttcagtcagatgatcataaaatgcaagtatgattaagtcatggcctcaacttttaaggaatgatgggctcaccttgctttcattcttgccacctcctcaatgaaaatgaaagatgtttttgggaaactgatagctaattttctttttcttagaatatttgatttagataatatgtatttaaaataaagttatcacgt

SEQ ID NO: 13463 - DNA, 7640 bp, Homo sapiens
ggcttacgcctgtaatcccagcattttgggagcccaaggcagatggatcacctgaggtcaggagttcgaaaccagcctggccaacatggggaaaccctgtctctacaaacaatataaaagttagctgggcatggtggtgcatgcctgtaatcccagctacttgggaggctgaggcaggagaatcacttaaacccgggaagcggaggttgcagcgagccgagatcacgccactgcactccagcctgggtgccagagcaactccatctcaaaaaataaaaataaaaaataaagtgggctccagtttcccaggtgcttgggggtgggcaggttggaggccagagatggcttctacatcttgacagcaggcaggcttcgaagtgctggcattcagatgtgtctcctgctgtttctgatttactgtcccccaccccagttcatcgaagcccggctggagaagctcaacaagggggagggcttctcagatcaattcgagcaggagatcactggctgcggggcctcctcaggtgagccctgagtccagcccctgggtcccccactacccgccaccagcacccccagcctcagccagccttcggtgaccaccacactctctccttaccccaggggcccttcgatcctatcagctctgggccgacaatctaaaggtaagaccaccagaacaataggccgtgggcgttggcttaggcctgtaatcccaacacattaggaggtggagatagaaggattgctgcgaccagaagtttgagaccggttagggcaacgtgacgaaaccccatctctactgaaaaaaaaaaaattcgctaggtgtagctgtagtcccagctactcgggaggctaaggtggaaggatggcttgagccccaggaggtggaggttgtagtgagccgagatcatgccactgcactccagcctgggtgacagagcaagaccctgtctcaaaaaccactttgttgcctgggcacggtggctcatgcctgtaatcccagcactttgggaggctgaggcaggcgaattgcctgaggtcaggagtttgaggctgaggcgggcggatcacaaggtcaggagatcgagaccatcctggccaacatggtgaaactctctctctactaaaaatacaaaaattagccgggtgtggtggcaggcgcctgtagtcccagctactcgggaagctgaggcaggagaatcgcttgaaccagggaggtggaggttgcagtgagccgagatggcaccactacattccagcctgggtaacagagcaagactgcatctcagcaaaaaaaaaaaaaaaacaaaaaaaaactgttctttgagactccatctcaaaaaaaacaaaaacaaaacacttaagtgtgtctcattggattaatttaactccgcaagtcaccaggtagggtcatgactacgatcatgttcatttatagaggtgaaaaaatggagactcagagagggaaaggggcttgattggcatcacacaacctgggatggggaggtgggatctggccctagcctctcccccttggtatcttctctcccgcagaaaggtggtggcgccctcctgcactcagtcaaggccaagacccaaccagccgtcaagaacatgtaccgctcggtgaggctgagctggacaggccactcttgctggggtgacgagggggaggggacagaggacactttgacctcccaaggatggagtattttgaccctggcagacactttaaacacaaatgatttaatcagaactgaaccagcagttaaaccattaacaactcttcccccttttattttttatttattatactcattttttgttggaatcctacccgcccccctccgccccgcccacggcccctttaaaattgacagccaagatttgctggcaaacattctttttgtccttggatgctacaattccaggttctgccttttatctcccaagctcagaagtttcctggggccaatttttgcagctcaaaattgtccgtgcgattttgttcttcaccgctttgaaacaggaacaccttgccctgttgctttgccactccccattttctttggggatgactgcctccaggaatactcattttatattagtcaaaggggtgaaagtttgcattgacttcttaggtggtgtatggggggtggtgaacgtatttgagacatgcagatggcaaaaaaaaaagctatcttaggggacagaaggctgagctctcaaatgcccaggatcccaccacccttgggtaattctctgtccactcctttataggccaagagtggcttgaagggggtgcagagccttctaatgtataaggtaagatcaactggccgggtgcagtggctcacccctgtaatcccagcactttgggaggccgaggcaggaggattgcttgagcccaggagtttgagaccagcttgggcaatatagtggggccttgtctctacaaaaaaatagttaaaaattatctgaatatggattgcttgagtctagaaggcggaggttgcagtaagctgagatagcgccactgtacaccagcctgggtgacagagagaccctgtctcaaaaaaaagaagactgtggctgggcacggtggctcacgcctgtaaccccagcactttgggaggccgaggagggtggatcacttgaggtcaggagttctagaccagcccgaccaacatggtgaaaccccatctctactaaaaatacagaattagctgggtatggtggcgcacgcctgtaatcccagctacttgggaagctgaggcatgagaatcgcttgaacctgggagtcagaggttgcagtgagccgagatggcaccactgcactccagcctgggcaacatgagtgaagcttcatttcaaacaaaaaaaaaaaaagactaactaaagaccaatggtagggggtggtggggagactctgtggcagaggttcccagttcactcttctcttcctaggatggggactctgtcctgcagagggggggctctctgagggccccagccctccccagccgctcagaccgcctgcagcaacgcctcccaatcactcagcactttggaaaggtgagagcgcccctccccccatgcacacacctggaattatcactgaatcctctacccatcccagtccccatccagacatctcacctccttcttcaactccccaaatatgtggcacccacttcacactcacccttctccagcaagcctcagccccccgattctgcagtctcctgaggtcctatcgcccccaccctttgcagaaccggccccttcgccccagcaggagacgccagctggaagagggaacttccgagcccccaggggcggggtaaggcaaaaagggaacagcagtgttgaaagtgggaggccaggactgatggggaggagggttcccaaactccagagcagcctgaccagggctgggggtcttgggcaaatatctgaggctgcccatcctcacccaggacacccccactgagccctgaggatgaggggtgcccgtgggcagaagaagctctggacagcagcttcttggggtctggagaagaactggatttgttgagcgagattctggacagtcttagcatgggagccaagagcgcaggcagcctgagaccgagccagagtttagactgctgtcacagaggagacctggacagctgcttcagcctggtgagagcctcgcccactcccccaaccctaccccaagtcttcccctaatggtccatccaacttgccagcccctctgccatctaaaagccacaacttccctatccatctcacctagcccaacataccaagatggcaaccagacgataagaaactaccagagccggagccccagcccctttccctgccatccctgcaaaatgcctcgtctttggatgccaccagctcttcaaaggactccaggtcccagctgataccctcagagtccgaccaagaagtcacgtctccatcccagtcctcaacagcttctgcagacccaagcatctggggggaccccaaaccctctcctctcacagagcccctaattcttcatctcaccccttcccacaaggcagctgaagattctacagcccaggaaaaccccactccctggctctccactgcacccactgagcccagccctccagaaagcccccaaattctggcccccacaaagcccaactttgatatagcctggacgtcccagccccttgatccttcctcagaccccagttctctggaggaccccagagcccggcctcccaaagccctgctggcagagcgcgctcacctccagccacgggaggaaccaggagccctgaattcccctgctacacccaccagcaactgtcaaaagtcccagcccagcagccggcccagagtcgctgatcttaagaagtgctttgagggttaagaatcaggggtccaagagagaccccagtccctcaataaagccacaagagcccaaaaaagctggtttttttcctggtgaatttctctggtgccctcactctgctcggaaatccatcccacccacctctgtccctccaagggcagcctctctaactggctcctagcagggaattccaggaagcctcctggtcttctagaatcctggcaaccttacaattcctctcggcatttgtcacttccatctcagctaatgcacccaccagctcaaacacaccaataaagcttttgttacatctcactactaattttatataaatatataaaagtgaatagccccatcctctcttgacctcaggggcagagtctttgaagtaccttcttccctgctattaagcactgggtggatctgactgcccagagagggcactgcctttccccaaggtcacacagcaatgaagggagacagatgcaggagaggggacctagatgggcaggcagccctgcaccgtctccttggagtcctgaggggcccgggcctcggctgcatgggagaactgaaagaaaggagagggggttgtggggcctgctggacacacagagaaaagttggttccgcaagcaggggggtgggtcccgagccccagcaccctgagctgcaggcacagccaagcagaggcaacatgctgcacagagcccaccacatgggtgcccccagcctctccccacaagtcctcctgagccatcagaggctggtgtctcggtggcagctgcagtgtacaagccagcaacccgcagtcctgggcagtgttggtggctgcagcaggccccagcgttcagatgagccgctcttccggcggcaacttgaggttgggggtcggtggcacgcgggcacccacctgctcctcgctactgggccggtaggtgccctccgtctgccgcttctcccgaagcttccgcaccaacagtgccagccccacagccaggagcaaggcagccaagagggagaagaccacgatgatagcagtgatggcttccggacgctgcagagaggggacaggtgtgaatcacctgagcctgggtagcctgtccacctccacctgaatggcatccccctcatcaccccctaccccacaacacacacacacacatacacacatctgccacttttggtgatctgatccccacagtggggcttcctggatccctacctaccttgtctggggtgcgaaggctccccaccacctgccatgtccgggacacccctcgcaagcacctgccatgtctgggactccggcttttttttttgagaccgagtcttgctctgttgcccaggctggagtgcagtgtcacaatctcggctcactgcaacctccgccttctgggctcaagcgattccccctgcctcagcctcccaagtagctgggattacaggtgtgtgccaccccgcctggctaattttttgtatttttagtagagacagggtttcaccatgttggccgtgctggtttcaaactcctgacctcatgattttcctgcctcggcctcccaaggtgttaggattacaggcgtgagccaccgcgcccggccgggactcctgctttcatcacatctaccaagtctgagctccttgctcccccacccacctgagaggcatatggaattcctgagcccacacatctgacagctacagtattcctgcccactccctccagggtgtcctagtcttcttggtctaagacttcaggtctctcctacttagagctctccaaagccaccctgacctgccacctctggggggagggggtgtctagtcctctctacatgctatatgtgtgacccctagataacatccttgctgccatcttcccacatatacctccaactcaccaggttgccatcggagctggagctggtggatgaaggcaaaacagtgctattctcatttgcagaagtggtctgtactgtggagggtgaaggcagagaataactcagtctccatctttctctcccatccccgcccatctgcacctgctttgggcattccccttcacctccccctagcaggtcccaattcaaactctgcctttcattcgcacagagatggttgggtgtcttgcaggtaagacctctcccttgggtgtttgctccccaggacaccccccccacccagtcccgcagagcccagtagggtgtccagaagtccacccctcccctactcacctctcggccctgggcccttaaggatctgggcgggcctagcttttccctggagtgtctgactcacacctccccacaggctcccaaaacaaatctaagactgaatggctggggtctacaccttcagccaaccaggtcgacccggctcggcaggcctcctcccagctcccagttcacccaaaaacacctgcactataccaagactcaggtacgcagcccttacctccccccaagtcctacttaggagcccccactccaacacacaattccacctcgctggggaactcaggtctcctagaccaactcccagtgtccaaggaagaaactagaaatcttaatccccccgagccctaaccctgtagaaccctccccaaggtatttcttccccgctccccaattcttgaccctctctgcgccccagatacccagcgcttctaagccacgtccccagcagagatccaggaatccagacccctcccccccagcgctctcagctggtacctactttgcccccaggctcggccccagcgggccagcaggaacggcaggcccagcgccagaagcagccccagcccggggttcgccatgggctgggtggcgggttggcagcgccgaggaaggggcttctcgcgctcgcccctcctaccgcatctccggccaggggcacctgcgacggggcacctggggacaggagaaggagaggcccaggcgttgggatcggggtggggaccccggcgcaggcccacaggagagacaactggcgccagggcacccatgagtcccgccccgccccagccgccagaggtcagcgattaaagattaactcccaggagcgcgttcctgggctggggaaaggaaggggacgggacgggacgggacgggacgggcagggtggacgggcgagggggcaggcctagcggtgcgtcctgccttcctacctggcccgggcgtctttgacctagctcaggttcctggtccgtgtccctccctcgaaccctcggtccg

SEQ ID NO: 13464 - DNA, 124 bp, Homo sapiens
gggcgcctgtaatcctagctacttgggaggctgaggcaggagaatcgcttgaaccctggaggcggaggttgcagtgagccgagatcacgccactgcactctagcctgggtgacagagcaagact

SEQ ID NO: 13465 - DNA, 4964 bp, Homo sapiens
gcggagtcgctgaccgagcgaaccccgcccccggcgccatcttcccgactgtgagccgtccaggtacccggggcccggccggtgggcggggaaggggcagagtggggagaggcgactcagggcctggcaccctctgggcgcgcctaggccccggcacagcttcggctgagcgccgcaaaagtcacgttattggcatgttctagaaactggctttccttgctcgttgtccactctgcgaggttgttttgcacatttgcttgtggccgcagaacgtccgctttcgctgttaggcagaagctcctgcgtggttggggcggttggctcctcggcgctctcctgcctggcggctccgtgacggctgccgagcagcctcggtccccaccccgcggctcgcaatggcctcgaccctcggagagcttgacccagacgttccctacctacatgagcggcgacgccctttcccggctcttcctcggctggggcgccccagggcttcggcgcgggcggccttccctcacttctgctcttctcccatccccggtagcaccgtccactcccagttagccggctcagcgctgctctcccgggcctctccaccgagagcttcctgcgcctgcccgccaggcccgctcctcctcccctctccgtctgagtttatcttactgcccggcccattgggccaaaaacaggggtgtcgttcgtaactcctttattttaatcctatctcaaatccctcggcggatctgacggctccactttcaaagagagaacgtctggagctggcccagcttccgtgctaggcaggaccctcccacgggccccgctcccattgtttttccacagctcgctgcccaactaggggcacctctccatcttcattccctaggaccccctctttcgagaagctgcaccttcagcttgttggttcctccaagttcatgcctacttaaaggcgggctgttaagtgtgttgtttcctgtgccccaaactctcctcgtgggccatcaaacagctgcctgccgccctcataacctccctcaacctccagcttgaaccacactccattgcagcccccgccccgctctcctgagtgtccatagtacctcactttttctggtagcccctatagcaccctgtgtgttcaccattattgagcttaggagagctcttcatggagccctgggtctccaggacctggcacttacgggctgtctttttttgtcggttttttttgttgttcgtttgtttgttttgagacagggtcttgctctgtctcccaggctggagtgcagtggctcagtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgatccgctcacctcggcctcccaaagtgctgggattacaggtgtgagccagcgcctggcttaggggccatctttgagtcggccctggctctgctccccaggtctcagtgctgtgccccccccagagcctagaggatgtttcatgggatcccagccacgccgggcataggaggtgagtgtggctggaagggcgcaggctttcagccgcttctgcaggggctgacgggcagtattgggtattggggatcgggggtggggaggtatctgaccctgctctcgtacagccttgggggtggccaggggctaaatagttcattgcaggagcactgagggctcagaaacctccagacagaactggcttggtcctgctgggcagagatgatgagcttcggtgtggccagaacggtgggggtcttgggcaccctgtgtcaccaatcccaggggagaggctgtgtgtggtgagccttgttggcactgcatcatgagccacgagcagggcgtggccactgttgtgcaggtgactccgccagggagccatggtggagctggggagatgggcctgtcatgcggtcccccggggagccgcagtggagctggggagctgggcctgtcatgcggtcccccggggagccgcagtggagctggggagctgggcctgtcatgcggcccccggcttctcagaggtgttatcatcaggtccccccacacactgataggggtgaggttggaacctctgtgctccagctccctctgggctctttgggacccagcctgggaggcctcagggaggaactgaaatggagactgggactggagtctgcccttgggttccctttggggccagcctgccagctctctgccttctcttgcagcccctgggaacaagccggagctgtatgaggtgagtggtgggtgcccacccggccggcattggccaacagcaaatgcctgtgtggcctcaccagggtcctgcagcccctgttggcactggcccacagagcccgctctctccggcaggaagtgaagttgtacaagaacgcccgggagagggagaagtaagtccaggcgcccaggctgtcccaacacacccatgcgcatctggctgccctggggcagcccctccagacccaccccaaactgaggggtgggaggacgcagggtcagtctggggaactgttcctgaggcactccaggatggagcaagaggtgggcagagcgcccgcagtggcacctccgggcagggggtagcactctgggctctaggcttggcaccccggggcctggcccgatagacaggtgtgtcctcaggtacgacaacatggcagagctgtttgcggtggtgaagacaatgcaagccctggagaaggcctacatcaaggactgtgtctcccccagcgagtaagagcccacgtcctgggaggtctgttcctgccctggggggcttgggtgctccataggcagcaagagcaggcgtctgtcaggctgggaggcacccacttgtgtggggcccacccagcgtgaggagggtgcccctgggtctcagccagggaagtcctgggggctggtgagggaggcgggcagaggcgcagctcctggggtgtcatccggcccattcccccaccctcatcccccagcacaggcaaccttaaaaaacggtcgagaggcttggggatgtcccaggatcttttgggggggctttgttcaatgaagtgacaagaccgtcacaggccaccgcacaggaccatgagctgtggatgcggccatcacaacagagggctggtcgctgtggttcagagggtgggcaggggttgggggccggggtctccacctggagccgagctacaagccccactacgtgctcagggcctcacccccaaaagatactagcagcccctcctccttgctcggcctgcctttgcctgtcgcctggtcctctctggaagctgctctgcctctggaccagccgagggggtaggatgagctgggtggggctggtcccatgcttgggcagcagctgacctctccctaggtacactgcagcctgctcccggctcctggtccaatacaaagctgccttcaggcaggtccagggctcagaaatcagctctattgacgaattctgccgcaagttccgcgtgagtgcctggtccttccacccccatggggcgagactgtcgggcatgggtatggggtgccagagggctctggccacctggggcttgctgtcctgagagccccagcacccatgtcacccccaacagctggactgcccgctggccatggagcggatcaaggaggaccggcccatcaccatcaaggacgacaagggcaacctcaaccgctgcatcgcagacgtggtctcggtgcgccccagcccccagggcacgtggttaggagagccgaggctgcctgctgcagctgggcacgagcgtagggtcctgggcctccagagctgagcagcactctgacttgctgggcagaagggaacccctttaactaggaatgaggggtgggcagcatgcggggacgcccccaggccacctggattcctgtcggggggatgagcacagggtgcgttctggcggggtcctggcctcgggagagagtgtgggtgtgggcccacccttcagttcccacacagctgtctgggcagccaggacctcgttcacccaggaggcctgctgggtttgggaacagagtacagtgaggaggcccaagtgacagctgtggctgaggaggggttggggcccgtgagccgtggggcctcccgcacccgtggacacgcgagcctcatgtgcacacctgcccccagctcttcatcacggtcatggacaagctgcgcctggagatccgcgccatggatgaggtgcgggtattgggctggcagggggcctaggcaggaggggatggagccggcgtcggggtcccagccgctgtgtgtgtctcagatccagcccgacctgcgagagctgatggagaccatgcaccgcatgagccacctcccacccgactttgagggccgccagacggtcagccagtggtgggtgtccctcccagccaggcagagccccgcagtgcccgagaccctcccagccaggcggagccccgcagtgcccctgaggccctcagcccccacatgccctgtgctgcactcccaggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgaccttcctgcttgggtggctcccccaggcctgccc

SEQ ID NO: 13466 - DNA, 4964 bp, Homo sapiens
gccgagtcgctgaccgagcgcaccccgcccccggcgccatcttcccgaccgcgagccgtccaggtacccggggcccggccggtgggcggggaaggggcagagtggggagaggcgactcagggcctggcaccctctgggcgcgcctaggccccggcacagcttcggctgagcgccgcaaaagtcacgttattggcatgttctagaaactggctttccttgctcgttgtccactctgcgaggttgttttgcacatttgcttgtggccgcagaacgtccgctttcgctgttaggcagaagctcctgcgtggttggggcggttggctcctcggcgctctcctgcctggcggctccgtgacggctgccgagcagcctcggtccccaccccgcggctcgcaatggcctcgaccctcggagagcttgacccagacgttccctacctacatgagcggcgacgccctttcccggctcttcctcggctggggcgccccagggcttcggcgcgggcggccttccctcacttctgctcttctcccatccccggtagcaccgtccactcccagttagccggctcagcgctgctctcccgggcctctccaccgagagcttcctgcgcctgcccgccaggcccgctcctcctcccctctccgtctgagtttatcttactgcccggcccattgggccaaaaacaggggtgtcgttcgtaactcctttattttaatcctatctcaaatccctcggcggatctgacggctccactttcaaagagagaacgtctggagctggcccagcttccgtgctaggcaggaccctcccacgggccccgctcccattgtttctccacagctcgctgcccaactaggggcacctctccatcttcattccctaggaccccctctttcgagaagctgcaccttcagcttgttggttcctccaagttcatgcctacttaaaggcgggctgttaagtgtgttgtttcctgtgccccaaactctcctcgtgggccatcaaacagctgcctgccgccctcataacctccctcaacctccagcttgaaccacactccactgcagcccccgccccgctctcctgagtgtccatagtacctcactttttctggtagcccctatagcaccctgtgtgttcaccattattgagcttaggagagctcttcatggagccctgggtctccaggacctggcacttacgggctgtctttttttgtcggttttttttgttgttcgtttgtttgttttgagacagggtcttgctctgtctcccaggctggagtgcagtggctcggtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgatccgctcacctcggcctcccaaagtgctgggattacaggtgtgagccagcgcctggcttaggggccatctttgagtcggccctggctctgctccccaggtctcagtgctgtgccccccccagagcctagaggatgtttcatgggatcccagccacgccgggcataggaggtgagtgtggctggaagggcgcaggctttcagccgcttctgcaggggctgacgggcagtattgggtattggggatcgggggtggggaggtatctgaccctgctctcgtacagccttgggggtggccaggggctaaatagttcattgcaggagcactgagggctcagaaacctccagacagaactggcttggtcctgctgggcagagatgatgagcttcggtgtggccagaacggtgggggtcctgggcaccctgtgtcaccaatcccaggggagaggctgtgtgtggtgagccttgttggcactgcatcatgagccacgagcagggcgtggccactgttgtgcaggtgactccgccagggagccatggtggagctggggagctgggcctgtcatgcggtcccccggggagccgcagtggagctggggagctgggcctgtcatgcggtcccccggggagccgcagtggagctggggagctgggcctgtcatgcggcccccggcttctcagaggtgttatcatcaggtccccccacacactgataggggtgaggttggaacctctgtgctccagctccctctgggctctttgggacccagcctgggaggcctcagggaggaactgaaatggagactgggactggagtctgcccttgggttccctttggggccagcctgccagctctctgccttctcttgcagcccctgggaacaagccggagctgtatgaggtgagtggtgggtgcccacccggccggcattggccaacagcaaatgcctgtgtggcctcaccagggtcctgcagcccctgttggcactggcccacagagcccgctctctccggcaggaagtgaagttgtacaagaacgcccgggagagggagaagtaagtccaggcgcccaggctgtcccaacacacccatgcgcatctggctgccctggggcagcccctccagacccaccccaaactgaggggtgggaggacgcagggtcagtctggggaactgttcctgaggcactccaggatggagcaagaggtgggcagagcgcccgcagtggcacctccgggcagggggtagcactctgggctctaggcttggcaccccggggcctggcccgatagacaggtgtgtcctcaggtacgacaacatggcagagctgtttgcggtggtgaagacaatgcaagccctggagaaggcctacatcaaggactgtgtctcccccagcgagtaagagcccacgtcctgggaggtctgttcctgccctggggggcttgggtgctccataggcagcaagagcaggcgtctgtcaggctgggaggcacccacttgtgtggggcccacccagcgtgaggagggtgcccctgggtctcagccagggaagtcctgggggctggtgagggaggcgggcagaggcgcagctcctggggtgtcatccggcccactcccccaccctcatcccccagcacaggcaaccttaaaaaacggtcgagaggcttggggatgtcccaggatcttttgggggggctttgttcaatgaagtgacaagaccgtcacaggccaccgcacaggaccatgagctgtggatgcggccatcacaacagagggctggtcgctgtggttcagagggtgggcaggggttgggggccggggtctccacctggagccgagctacaagccccactacgtgctcagggcctcacccccaaaagctactagcagcccctcctccttgctcggcctgcctttgcctgtcgcctggtcctctctggaagctgctttgcctctggaccagccgagggggtaggatgagctgggtggggctggtcccatgcttgggcagcagctgacctctccctaggtacactgcagcctgctcccggctcctggtccaatacaaagctgccttcaggcaggtccagggctcagaaatcagctctattgacgaattctgccgcaagttccgcgtgagtgcctggtccttccacccccatggggcgagactgtcgggcatgggtatggggtgccagagggctctggccacctggggcttgctgtcctgagagccccagcacccatgtcacccccaacagctggactgcccgctggccatggagcggatcaaggaggaccggcccatcaccatcaaggacgacaagggcaacctcaaccgctgcatcgcagacgtggtctcggtgcgccccagcccccagggcacgtggttaggagagccgaggctgcctgctgcagctgggcacgagcgtagggtcctgggcctccagagctgagcagcactctgacttgctgggcagaagggaacccctttaactaggaatgaggggtgggcagcatgcggggacgcccccaggccacctggactcctgtcggggggatgagcacagggtgcgttctggcggggtcctggcctcgggagagagtgtgggtgtgggcccacccttcagttcccacacagctgtctgggcagccaggacctcgttcacccaggaggcctgcagggtttgggaacagagtacagtgaggaggcccaagtgacagctgtggctgaggaggggttggggcccgtgagccgtggggcctcccgcacccgtggacacgcgagcctcatgtgcacacctgcccccagctcttcatcacggtcatggacaagctgcgtctggagatccgcgccatggatgaggtgcgggtattgggctggcagggggcctaggcaggaggggatggagccggcgtcggggtcccagccgctgtgtgtgtctcagatccagcccgacctgcgagagctgatggagaccatgcaccgcatgagccacctcccacccgactttgagggccgccagacggtcagccagtggtgggtgtccctcccagccaggcagagccccgcagtgcccgagaccctcccagccaggcggagccccgcagtgcccctgaggccctcagcccccacatgccctgtgctgcactcccaggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgaccttcctgcttgggtggctcccccaggcctgccc

SEQ ID NO: 13467 - DNA, 4014 bp, Homo sapiens
tcccagctgggagaatttgggcgagagcctttgcttctgcacttgccaccccaccctgcgagcactgcggtagtggtttccccaaaggggtcctgagggttctgggcccagaacttggggtgggtacagggctgtggccacgtggggctgacggattctggccccggtgcagatgctgagcacctgaagaccctgtccctgtcctacaacgccctgggagcccctgccctggccaggaccctgcagagcctgcccgccggcaccctcctgcacttagagctcagctccgtggcagccggcaagggtgattcggacctcatggagcctgtattccgatacctggccaaggtacgaggtggggaagaacccagaaaatactgagcctcagaggccaaaggtcccagggttgctgggaggagctcgcctctccccagattcgggctgaactcgctgaggggctctacagagagagttagaggtttggaggtttagaaaaaacagctggggggccaggcgcggtggctcacgcctgtaatcccagtactttgggaggccgaagggggtggatcacaaggtcaggagttcaaaagcagcctggccaacatggtgaaaccttgtctctagtaaaaatacaaaaattacccaggcgtggtggcgggtacctgtaatcccagctactcgggatgctgaggcagagaattggttgaacccgggaggcagaggttgcagtgagcctagattgcaccattgcacccagcctgggtgacagagcgagattccgtctcaaaaaaaaaaaaaaagaaagaaaaagaaaaaaacaggctgggcgtggtagcttacgcctgtaatcccagcactttgggaggccgaggcgggcggatcacgaggtcaggagatcaagaccatcctggctaacatggtgaaacaccatctttactaaaaaatacaaaaaattagccgggcgtggtgacgggctcctggagtcccagctacttgggagacaggcaggaaaacagcgtgaacccgggaggcggagcttgcagtgagccaagatggcgccaccgcactccaccctgggcgacagagcgagactctgtctcaaaaaaaaaacaaaaaaagaaaaaaacagctgggggaatgcttttgtacagctgcctgtctcaggctgtgaattcctgcccaccagataggacccgggactcagggtgatcttgccccccgccaggaaggtcccaaggggcacactagggcccctgatgctctctcctggggggtcttccaggcacaactgggaccctattattttcacactatcacgtgcagagtgtgacccacatcaggagaggtgtttccttccgatctccaactagatgggggactctgctcccttctgggcccctgggtgtggtgcacctgctgggaagcaggcagggcaggtgcgccactccgtttggcccccttgggcctctgctcatgtccaggaaggctgtgctctagcccacctgaccctgtctgcaaaccacctgggggacaaggctgttagagacctgtgcaggtaacgccctttccctgctgcctgctgacctgggggtctgatctcatggctctggaccctatgggagaagggccacagaaatggtaccagctcctcctccccagcacatcccaagacctggctccttcggtttccaccagcctctcaggctgccctggaaggcagactaccctctggcttctttcttagcatgggcctgtggctcttgagagcactcctccgggggtgtccttgtcattcctgtgcctcggcccacatgagggcactgctcttatgacctggagcctcagtcagctctctggggagtgttgagaggagcccaagctgggccaggcacacccagagctggccactgtggccctgacccctgggaaggacccccaaccctagagggccacctgctactgggccaggctgaggcagagcccctgggtctggcccgaggctccctgagctggcatttgtctgggcagctttcctagtgttggggcacagcctctctggaagccaacctttgcacttcttcccatgttatctcagatgtctctctctgtgcccctcactcatctcactggatctgtctgccaaccctgagatcagctgtgccagcttggaagagctcctgtccaccctccaaaagcggccccaaggccttagcttccttggcctgtcaggtgagtgctggtatggtggccacgcctgccatgttcggccttttcagggacctgcctgagacccaggtgcctcctcctaaggggctgtcactgctaccagccaggcagcaaggctgggctccatgaggctggggcagcagggggcagagtgacagtgacagaaaaggggcatgatcccagctcctaaaaccatgggttagggggcgaggtgggtatctgcctctggtttctccaacccaaccttcagagcagattatggtaggcaagaccctgttccacagggactttcttcttgtccttggcaggaaaagggatcccaaggtcagggtgttgaaagctgccaagggaccctcctacttcctggcaggggctcctctgacacaaccctgcccagggctgtggtctgatttagcttgttctctcttgagccacatcagggcagtccccaacctgagctgtctggaagacaaccccaggaagggctttgatgacctggcttgccccactggggccggggcaggctgtgccctccaggggatgagggcttaagtgaatgtgcacgaagcggggctctgctttcttcctgtgccccctccccttcacctcccagggccaggccgccttttccaggaaggcccccgagtgctggtgtgagaccccttccccacacctcagttcctggcatctgtaccttcccacccagctccctgaattcctgagcttagtgttctcttgatccactcaggcccacgatgtacagatttgcaagcagatccattatgtccttcttatgggtggggagactgacgtgtaggcatggactttgagatcgggcactgtcagaggtaaagaaaggagccacccttcctcctgtctgaccgctggctgtgcagatgatcccaccccttcctggagagtcatggggcctctccggagctctgcccactgcccctcgctacagccctggggccctcagcgaaagcgagtttgttccctggagcctgccgcgggcaccaggacgccgccggcccccgcagcgctgaggtctgccctcttcccctccgcaggctgcgccgtccagggtcccctgggcctgggcctgtgggacaagatagccgcgcagctccgggaactgcagctgtgcagcagacgcctctgcgctgaggacagggacgccctgcgccagctgcagcccagtcggccgggccccggcgagtgcacgctggaccacggctccaagctcttctttcggcgcctctgaccctggcgctgcctttccccaccctcaccgaagcccctaataaatgaagctgctggccgggcgcggtggctcacgcctgtaatcccaacactttgggaggcccaggcgggcggatcacgaggtcaggagatcgagaccatcctggctaacatggtgaaaccccgtctctactaaaaataccaaaaattagccgggcgtggtggtggaagcctgtagtcccagctactccggaggctgaggcaggagaatggcgtgaacccgggaggcggagcttgcagtgagccgagatcgcaccactgcactccagcctgggcgacagaccgagactccgtctcaaaaaaaaaaaaaaataaaataaatgaagctgctgcctccctccccgtggctgcctggcaggcgggtgggcggggtaagaccgggcttcgagtctgctgcgccggttacgtcccgggggctgcgcggctggagggaatgtcccgaagtcctggcgggcgcgggcgcaggcgtgagggctgagcgccgag

SEQ ID NO: 13468 - DNA, 4013 bp, Homo sapiens
tcccagctgggagaatctgggcgagagcctttgcctctgcacttgccaccccaccctgcgagcactgcggtagtggtttccccaaaggggtcctgagggttctgggcccagaacttggggtgggtacagggctgtggccacgtggggctgacggattctggccccggtgcagatgctgagcacctgaagaccctgtccctgtcctacaacgccctgggagcccctgccctggccaggaccctgcagagcctgcccgccggcaccctcctgcacttagagctcagctccgtggcagccggcaagggtgattcggacctcatggagcctgtattccgatacctggccaaggtacgaggtggggaagaacccagaaaatactgagcctcagaggccaaaggtcccagggttgctgggaggagctcgcctctccccagattcgggctgaactcgctgaggggctctacagagagagttagaggtttggaggtttagaaaaaacagctggggggccaggcgcggtggctcacgcctgtaatcccagtactttgggaggccgaagggggtggatcacaaggtcaggagttcaaaagcagcctggccaacatggtgaaaccttgtctctagtaaaaatacaaaaattacccaggcgtggtggcgggtacctgtaatcccagctactcgggatgctgaggcagagaattggttgaacccgggaggcagaggttgcagtgagcctagattgcaccattgcacccagctgggtgacagagcgagattccgtctcaaaaaaaaaaaaaaagaaagaaaaagaaaaaaacaggctgggcgtggtagcttacgcctgtaatcccagcactttgggaggccgaggcgggcggatcacgaggtcaggagatcaagaccatcctggctaacatggtgaaacaccatctctactaaaaaatacaaaaaattagccgggcgtggtgacgggctcctggagtcccagctacttgggagacaggcaggagaacagcgtgaacccgggaggcggagcttgcagtgagccgagatggcgccaccgcactccaccctgggcgacagagcgagactctgtctcaaaaaaaaaacaaaaaaagaaaaaaacagctgggggaatgcttttgtacagctgcctgtctcaggctgtgaattcctgcccaccagataggacccgggactcagggtgatcttgccccccgccaggaaggtcccaaggggcacactagggcccctgatgctctctcctggggggtcttccaggcacaactgggaccctattattttcacactatcacgtgcagagtgtgacccacatcaggagaggtgtttccttccgatctccaacttgatgggggactctgctcccttctgggcccctgggtgtggtgcacctgctgggaagcaggcagggcaggtgcgccactccgtttggcccccttgggcctctgctcatgtccaggaaggctgtgctctagcccacctgaccctgtctgcaaaccacctgggggacaaggctgttagagacctgtgcaggtaacgccctttccctgctgcctgctgacctgggggtctgatctcatggctctggaccctatgggagaagggccacagaaatggtaccagctcctcctccccagcacatcccaagacctggctccttcggtttccaccagcctctcaggctgccctggaaggcagactaccctctggcttctttcttagcatgggcctgtggctcttgagagcactcctccgggggtgtccttgtcattcctgtgcctcggcccacatgagggcactgctcttatgacctggagcctcagtcagctctctggggagtgttgagaggagcccaagctgggccaggcacacccagagctggccactgtggccctgacccctgggaaggacccccaaccctagagggccacctgctactgggccaggctgaggcagagcccctgggtctggcccgaggctccctgagctggcatttgtctgggcagctttcctagtgttggggcacagcctctctggaagccaacctttgcacttcttcccatgttatctcagatgtctctctctgtgcccctcactcatctcactggatctgtctgccaaccctgagatcagctgtgccagcttggaagagctcctgtccaccctccaaaagcggccccaaggccttagcttccttggcctgtcaggtgagtgctggtatggtggccacgcctgccatgttcggccttttcagggacctgcctgagacccaggtgcctcctcctaaggggctgtcactgctaccagccaggcagcaaggctgggctccatgaggctggggcagcagggggcagagtgacagtgacagaaaaggggcatgatcccagctcctaaaaccatgggttagggggcgaggtgggtatctgcctctggtctctccaacccaaccttcagagcagactatggtaggcaagaccctgttccacagggactttcttcttgtccctggcaggaaaagggatcccaaggtcagggtgttgaaagctgccaagggaccctcctacttcctggcaggggctcctctgacacaaccctgcccagggctgtggtctgatttagcttgttctctcttgagccacatcagggcagtccccaacctgagctgtctggaagacaaccccaggaagggctttgatgacctggcttgccccactggggccggggcaggctgtgccctccaggggatgagggcttaagtgaatgtgcacgaagcggggctctgctttcttcctgtgccccctccccttcacctcccagggccaggccgccttttccaggaaggcccccgagtgctggtgtgagaccccttccccacacctcagttcctggcatctgtaccttcccacccagctccctgaattcctgagcttagtgttctcttgatccactcaggcccacgatgtacagatttgcaagcagatccattatgtccttcttatgggtggggagactgacgtgtaggcatggactttgagatcgggcactgtcagaggtaaagaagggagccacccttcctcctgtctgaccgctggctgtgcagatgatcccaccccttcctggagagtcatggggcctctccggagctctgcccactgcccctcgctacagccctggggccctcagcgaaagcgagtttgttccctggagcctgccgcgggcaccaggacgccgccggcccccgcagcgctgaggtctgccctcttcccctccgcaggctgcgccgtccagggtcccctgggcctgggcctgtgggacaagatagccgcgcagctccgggaactgcagctgtgcagcagacgcctctgcgctgaggacagggacgccctgcgccagctgcagcccagtcggccgggccccggcgagtgcacgctggaccacggctccaagctcttctttcggcgcctctgaccctggcgctgcctttccccaccctcaccgaagcccctaataaatgaagctgctggccgggcgcggtggctcacgcctgtaatcccaacactttgggaggcccaggcgggcggatcacgaggtcaggagatcgagaccatcctggctaacatggtgaaaccccgtctctactaaaaataccaaaaattagccgggcgtggtggtggaagcctgtagtcccagctactccggaggctgaggcaggagaatggcgtgaacccgggaggcggagcttgcagtgagccgagatcgcaccactgcactccagcctgggcgacagaccgagactccgtctcaaaaaaaaaaaaaaataaaataaatgaagctgctgcctccctccccgtggctgcctggcaggcgggtgggcggggtaagaccgggcttcgagtctgctgcgccggttacgtcccgggggctgcgcggctggagggaatgtcccgaagtccgggcgggcgcgggcgcaggcgtgagggctgagcgccgag
